United States Patent
Naumov et al.

(10) Patent No.: US 10,294,266 B2
(45) Date of Patent: May 21, 2019

(54) ENGINEERING SURFACE EPITOPES TO IMPROVE PROTEIN CRYSTALLIZATION

(71) Applicant: The Trustees of Columbia University in the City of New York, New York, NY (US)

(72) Inventors: Victor Naumov, New York, NY (US); William Nicholson Price, Barnesville, MD (US); Samuel K. Handelman, Columbus, OH (US); John Frances Hunt, New York, NY (US)

(73) Assignee: The Trustees of Columbia University in the City of New York, New York, NY (US)

(*) Notice: Subject to any disclaimer, the term of this patent is extended or adjusted under 35 U.S.C. 154(b) by 0 days.

(21) Appl. No.: 13/694,010

(22) Filed: Oct. 19, 2012

(65) Prior Publication Data

US 2013/0123467 A1    May 16, 2013

Related U.S. Application Data

(63) Continuation-in-part of application No. PCT/US2011/033135, filed on Apr. 19, 2011.

(60) Provisional application No. 61/325,723, filed on Apr. 19, 2010, provisional application No. 61/432,901, filed on Jan. 14, 2011.

(51) Int. Cl.
| | |
|---|---|
| *G01N 33/48* | (2006.01) |
| *C07K 1/107* | (2006.01) |
| *C07K 14/47* | (2006.01) |
| *G06F 19/18* | (2011.01) |
| *G06G 7/58* | (2006.01) |

(52) U.S. Cl.
CPC .............. *C07K 1/107* (2013.01); *C07K 14/47* (2013.01); *G06F 19/18* (2013.01); *C07K 2299/00* (2013.01)

(58) Field of Classification Search
None
See application file for complete search history.

(56) References Cited

U.S. PATENT DOCUMENTS

| | | |
|---|---|---|
| 5,290,690 A | 3/1994 | Mrabet et al. |
| 2007/0259417 A1 | 11/2007 | Ladner et al. |
| 2010/0068217 A1 | 3/2010 | Kwong et al. |
| 2011/0031438 A1 | 2/2011 | Stevens et al. |
| 2011/0033894 A1 | 2/2011 | Price, II et al. |
| 2012/0100593 A1 | 4/2012 | Stevens et al. |

FOREIGN PATENT DOCUMENTS

WO    WO-2011/133608 A2    10/2011

OTHER PUBLICATIONS

Baresic, "Structural analysis of single amino acid polymorphisms," PhD Thesis Mar. 3, 2012 [ according to document properties for posted document], [retrieved from the Internet Feb. 18, 2014; <http://discovery.ucl.ac.uk/1344177/1/1344177.pdf>], pp. 47-75, 85-114 (240 pgs.).
Cooper et al., "Protein crystallization by surface entropy reduction: optimization of the SER strategy," Acta. Crystallographica Section D, vol. 63(5), pp. 636-645 (2007).
Derewenda, "Application of protein engineering to enhance crystallizability and improve crystal properties," Acta Crystallogr D Biol Cystallogr, vol. 66(Pt 5), pp. 604-615 (2010).
Goldschmidt et al., "Toward rational protein crystallization: A Web server for the design of srystallizable protein variants," Protein Science 2007, 16, 1569-1576.
International Search Report and Written Opinion Issued by the U.S. Patent and Trademark Office as International Searching Authority for International Application No. PCT/US13/65748 dated Apr. 22, 2014 (16 pgs.).
Kurgan, et al., "Sequence-Based Protein Crystallization Propensity Prediction for Structural Genomics: Review and Comparative Analysis," Natural Science, vol. 1, No. 2, pp. 93-106 (2009).
Mateja, et al., The impact of Glu→Ala and Glu→Asp mutations on the crystallization properties of RhoGDI: the structure of RhoGDI at 1.3 A resolution, Acta Crystallogr D Biol Crystallogr, vol. 58(Pt 12), pp. 1983-1991 (2002).
Mizianty, et al., "CRYSpred: accurate sequence-based protein crystallization propensity prediction using sequence-derived structural characteristics," Protein Pept Letters, vol. 19, No. 1, pp. 40-49 (Jan. 2012) (2 pgs.).
Price II, et al., "Understanding the physical properties that control protein crystallization by analysis of large-scale experimental data," Nat Biotechnol, vol. 27, No. 1, pp. 51-57 (2009) (17 pgs.).
Ruggiero, et al., "Enhanced crystallizability by protein engineering approaches: a general overview," Protein Pept Letters, vol. 19, No. 7, pp. 732-742 (Jul. 2012).
Wine, et al., "Modification of protein crystal packing by systematic mutations of surface residues; implications on biotemplating and crystal porosity," Biotechnol Bioeng, vol. 104, No. 3, pp. 444-457 (2009).
Acton, T. B. et al., "Robotic cloning and Protein Production Platform of the Northeast Structural Genomics Consortium," Methods in Enzymology, vol. 394, pp. 210-243 (2005).
Altschul, S.F. et al., "Basic local alignment search tool," J. Mol. Biol., vol. 215, pp. 403-410 (1990).
Altschul, S.F. et al., "Gapped BLAST and PSI-BLAST: a new generation of protein database search programs," Nucleic Acids Research, vol. 25, pp. 3389-3402 (1997).
Banatao, D. R. et al., "An approach to crystallizing proteins by synthetic symmetrization," Proc. Natl. Acad. Sci. USA, vol. 103, No. 44, pp. 16230-16235 (Oct. 31, 2006).
Berman, H. M. et al., "The protein structure initiative structural genomics knowledgebase," Nucleic acids research, vol. 37, Database issue, pp. D365-D368 (2009).

(Continued)

*Primary Examiner* — Eric S Dejong

(57) ABSTRACT

The invention provides for methods and systems for engineering target proteins, based on protein sequence characteristics that influence the likelihood of obtaining a crystal suitable for X-ray structure solution, to improve protein crystallization, as well as related material.

7 Claims, 23 Drawing Sheets

Specification includes a Sequence Listing.

(56) References Cited

OTHER PUBLICATIONS

Bordner, A. J. et al., "Large-scale prediction of protein geometry and stability changes for arbitrary single point mutations," Proteins, vol. 57, No. 2, pp. 400-413 (2004).

Canaves, J. M. et al., "Protein biophysical properties that correlate with crystallization success in Thermotoga maritima: maximum clustering strategy for structural genomics," Journal of molecular biology, vol. 344, No. 4, pp. 977-991 (Dec. 3, 2004).

Chenna, R. et al., "Multiple sequence alignment with the Clustal series of programs," Nucleic Acids Research, vol. 31, No. 13, pp. 3497-3500 (Jul. 2003).

Cieslik, M. et al., "The role of entropy and polarity in intermolecular contacts in protein crystals," Acta crystallographica, vol. 65, Part 5, pp. 500-509 (2009).

Crabtree, S. et al., "Facile and gentle method for quantitative lysis of *Escherichia coli* and *Salmonella typhimurium*," J. Bacteriol., vol. 158, No. 1, pp. 354-356 (Apr. 1984).

Cumbaa, C. A. et al., "Automatic classification of sub-microlitre protein-crystallization trials in 1536-well plates," Acta crystallographica, vol. 59, Part 9, pp. 1619-1627 (Sep. 2003).

Cunningham, B. C. et al., "High-resolution epitope mapping of hGH-receptor interactions by alanine-scanning mutagenesis," Science, vol. 244, No. 4908, pp. 1081-1085 (Jun. 2, 1989).

Czepas, J. et al., "The impact of Lys→Arg surface mutations on the crystallization of the globular domain of RhoGDI," Acta crystallographica, vol. 60, Part 2, pp. 275-280 (Feb. 2004).

Dawson, R. J. et al., "Structure of a bacterial multidrug ABC transporter," Nature, vol. 443, No. 7108, pp. 180-185 (Sep. 14, 2006).

Derewenda, Z. S. et al., "Entropy and surface engineering in protein crystallization," Acta crystallographica, vol. 62, Part 1, pp. 116-124 (Jan. 2006).

Derewenda, Z. S., "The use of recombinant methods and molecular engineering in protein crystallization," Methods, vol. 34, No. 3, pp. 354-363 (Nov. 2004).

Ding, F. et al., "Emergence of protein fold families through rational design," PLoS Comp. Biol., vol. 2, Issue 7, e85, pp. 725-733 (Jul. 2006).

Edsall, J. T., "Blood and hemoglobin: the evolution of knowledge of functional adaptation in a biochemical system, part I: The adaptation of chemical structure to function in hemoglobin," Journal of the history of biology, vol. 5, No. 2, pp. 205-257 (1972).

Eyal, E. et al., "Rapid assessment of correlated amino acids from pair-to-pair (P2P) substitution matrices," Bioinformatics, vol. 23, No. 14, pp. 1837-1839 (Jul. 15, 2007).

Falconer, R.J., et al., "Chemical Treatment of *Escherichia coli*: 3. Selective Extraction of a Recombinant Protein From Cytoplasmic Inclusion Bodies in Intact Cells," Biotechnol. Bioengin., vol. 53, pp. 453-458 (1997).

Ferre-D'Amare, A. R. et al., "Use of dynamic light scattering to assess crystallizability of macromolecules and macromolecular assemblies," Structure, vol. 2, No. 5, pp. 357-359 (May 15, 1994).

Gilis, D. et al., "Predicting protein stability changes upon mutation using database-derived potentials: solvent accessibility determines the importance of local versus non-local interactions along the sequence," Journal of molecular biology, vol. 272, No. 2, pp. 276-290 (Sep. 19, 1997).

Gish, W. et al., "Identification of protein coding regions by database similarity search," Nature Genetics, vol. 3, No. 3, pp. 266-272 (Mar. 1993).

Goh, C. S. et al., "SPINE 2: a system for collaborative structural proteomics within a federated database framework," Nucleic acids research, vol. 31, No. 11, pp. 2833-2838 (2003).

Guerois, R. et al., "Predicting changes in the stability of proteins and protein complexes: a study of more than 1000 mutations," Journal of molecular biology, vol. 320, No. 2, pp. 369-387 (Jul. 5, 2002).

Hakes, L. et al., "Specificity in protein interactions and its relationship with sequence diversity and coevolution," Proceedings of the National Academy of Sciences of the United States of America, vol. 104, No. 19, pp. 7999-8004 (May 8, 2007).

Higgins, D. G. et al., "Using CLUSTAL for multiple sequence alignments," Methods in Enzymology, vol. 266, pp. 383-402 (1996).

Hunt, J. A. et al., "Allelomorphism and the chemical differences of the human haemoglobins A, S and C," Nature, vol. 181, No. 4615, pp. 1062-1063 (Apr. 12, 1958).

Jaroszewski, L. et al., "Genome pool strategy for structural coverage of protein families," Structure, vol. 16, No. 11, pp. 1659-1667, 19 pages (Nov. 12, 2008).

Kabsch, W. et al., "Dictionary of protein secondary structure: pattern recognition of hydrogen-bonded and geometrical features," Biopolymers, vol. 22, No. 12, pp. 2577-2637, (Dec. 1983).

Kann, M. G. et al., "Correlated evolution of interacting proteins: looking behind the mirrortree," J. Mol. Biol., vol. 385, No. 1, pp. 91-98, 17 pages (Jan. 9, 2009).

Kann, M. G. et al., "Predicting protein domain interactions from coevolution of conserved regions," Proteins, vol. 67, No. 4, pp. 811-820 (Jun. 1, 2007).

Kendrew, J. C. et al., "A three-dimensional model of the myoglobin molecule obtained by x-ray analysis," Nature, vol. 181, No. 4610, pp. 662-666 (Mar. 8, 1958).

Kendrew, J. C. et al., "A comparative X-ray study of foetal and adult sheep haemoglobins," Proc. R. Soc. Lond. A Math Phys. Sci., vol. 194, No. 1038, pp. 375-398 (Sep. 2, 1948).

Kendrew, J. C., "Structure and function in myoglobin and other proteins," Fed. Proc., vol. 18, No. 2, Part 1, pp. 740-751 (Jul. 1959).

Krissinel, E. et al., "Inference of macromolecular assemblies from crystalline state," J. Mol. Biol., vol. 372, No. 3, pp. 774-797 (Sep. 21, 2007).

Krissinel, E., "Crystal contacts as nature's docking solutions," J. Comput. Chem., vol. 31, No. 1, pp. 133-143 (Jan. 15, 2010).

Kuhlman, B. et al., "Native protein sequences are close to optimal for their structures," Proc. Natl. Acad. Sci. USA, vol. 97, No. 19, pp. 10383-10388 (Sep. 12, 2000).

Lessin, L. S. et al., "Molecular mechanism of hemolytic anemia in homozygous hemoglobin C disease. Electron microscopic study by the freeze-etching technique," J. Exp. Med., vol. 130, No. 3, pp. 443-466 (Sep. 1, 1969).

Liu, Y. et al., "Analysis of correlated mutations in HIV-1 protease using spectral clustering," Bioinformatics, vol. 24, No. 10, pp. 1243-1250 (May 15, 2008).

Longenecker, K. L. et al., "Protein crystallization by rational mutagenesis of surface residues: Lys to Ala mutations promote crystallization of RhoGDI," Acta crystallographica, vol. 57, Part 5, pp. 679-688 (May 2001).

Luft, J. R. et al., "A deliberate approach to screening for initial crystallization conditions of biological macromolecules," Journal of Structural Biology, vol. 142, No. 1, pp. 170-179 (Apr. 2003).

Madden, T.L. et al., "Applications of network BLAST server," Meth. Enzymol., vol. 266, pp. 131-141 (1996).

Marston, F. A. et al., "Solubilization of Protein Aggregates," Meth. Enz., vol. 182, pp. 264-275, 13 pages (1990).

Page, R. et al., "Crystallization data mining in structural genomics: using positive and negative results to optimize protein crystallization screens," Methods, vol. 34, No. 3, pp. 373-389 (Nov. 2004).

Price et al., "Large-scale experimental studies show unexpected amino acid effects on protein expression and solubility in vivo in *E. coli*," Microbial Informatics and Experimentation, vol. 1, No. 6, 20 pages (2011).

Rost, B. et al., "The PredictProtein server," Nucleic Acids Research, vol. 32, (Web Server Issue), pp. W321-W326 (Jul. 1, 2004).

Rost, B., "PHD: predicting one-dimensional protein structure by profile-based neural networks," Methods in Enzymology, vol. 266, pp. 525-539 (1996).

Rost, B., How to Use Protein 1D Structure Predicted by PROFphd. in The Proteomics Protocols Handbook, Walker, J. E., Ed. Humana Press: Totowa, pp. 875-901, 29 pages (2005).

(56) References Cited

OTHER PUBLICATIONS

Sammut, S. J. et al., "Pfam 10 years on: 10,000 families and still growing," Briefings in Bioinformatics, vol. 9, No. 3, pp. 210-219 (Mar. 15, 2008).
Saraboji, K. et al., "Average assignment method for predicting the stability of protein mutants," Biopolymers, vol. 82, No. 1, pp. 80-92 (May 2006).
Slabinski, L. et al., "The challenge of protein structure determination—lessons from structural genomics," Protein Sci., vol. 16, No. 11, pp. 2472-2482 (2007).
Spraggon, G. et al., "On the use of DXMS to produce more crystallizable proteins: structures of the T. maritima proteins TM0160 and TM1171," Protein Sci., vol. 13, No. 12, pp. 3187-3199 (Dec. 2004).
Stanley, W. M., "Isolation of a Crystalline Protein Possessing the Properties of Tobacco-Mosaic Virus," Science, vol. 81, No. 2113, pp. 644-645 (Jun. 28, 1935).
Sumner, J. B., "The Isolation and Crystallization of the Enyzme Urease," J. Biol. Chem., vol. 69, pp. 435-441 (1926).
Tymms, "In Vitro Transcription and Translation Protocols: Methods in Molecular Biology," vol. 37, Garland Publishing, NY, 10 pages (1995).
Ward, J. J. et al., "The DISOPRED server for the prediction of protein disorder," Bioinformatics, vol. 20, No. 13, pp. 2138-2139 (2004).
Wukovitz, S. W. et al., "Why protein crystals favour some space-groups over others," Nat. Struct. Biol., vol. 2, No. 12, pp. 1062-1067 (Dec. 1995).
Xu, Q. et al., "Statistical analysis of interface similarity in crystals of homologous proteins," J. Mol. Biol., vol. 381, No. 2, pp. 487-507, 37 pages (Aug. 29, 2008).
Yin, S. et al., "MedusaScore: An accurate force-field based scoring function for virtual drug screening," J. Chem. Infor. Model, vol. 48, No. 8, pp. 1656-1662 15 pages, (Aug. 2008).
Yin, S. et al., "Modeling backbone flexibility improves protein stability estimation," Structure, vol. 15, pp. 1567-1576 (Dec. 2007).
Zhang Z. et al., "A greedy algorithm for aligning DNA sequences", Journal of Computational Biology, vol. 7, Issues 1-2, pp. 203-214 (Feb.-Apr. 2000).
Derewenda, Zygmunt S., "Rational Protein Crystallization by Mutational Surface Engineering," Structure, vol. 12, pp. 529-535 (Apr. 2004).
Extended European Search Report issued by the European Patent Office for Application No. 11772593.7 dated Sep. 18, 2014 (11 pages).
Moon, A.F. et al., "A synergistic approach to protein crystallization: Combination of a fixed-arm carrier with surface entropy reduction," Protein Science, vol. 19, pp. 901-913 (2010).
Amy C. Anderson, "The process of structure-based drug design," Chem bio 2003, 10, 787-797. DOI 10.1016/j.chembiol.2003.09.002.
Gerhard Klebe, "Recent developments in structure-based drug design," J Mol Med (2000) 78:269-281. (DOI) 10.1007/s001090000084.
Irwin D. Kuntz, "Structure-Based Strategies for Drug Design and Discovery," Science, 1992, 257 (issue 5073), 1078-1082. DOI: 10.1126/science.257.5073.1078.
Barnes, Christopher O. et al., "Structural characterization of a highly-potent V3-glycan broadly neutralizing antibody bound to natively-glycosylated HIV-1 envelope" *Nature Communications*, 2018, 9-_1251-_doi: 10.1038/s41467-018-03632-y.
Jonathan P.K.Doye, Wilson C.K.Poon, "Protein crystallization in vivo," Current Opinion in Colloid & Interface Science, 11(1), 40-46 (2006) (doi: 10.1016/j.cocis.2005.10.002).

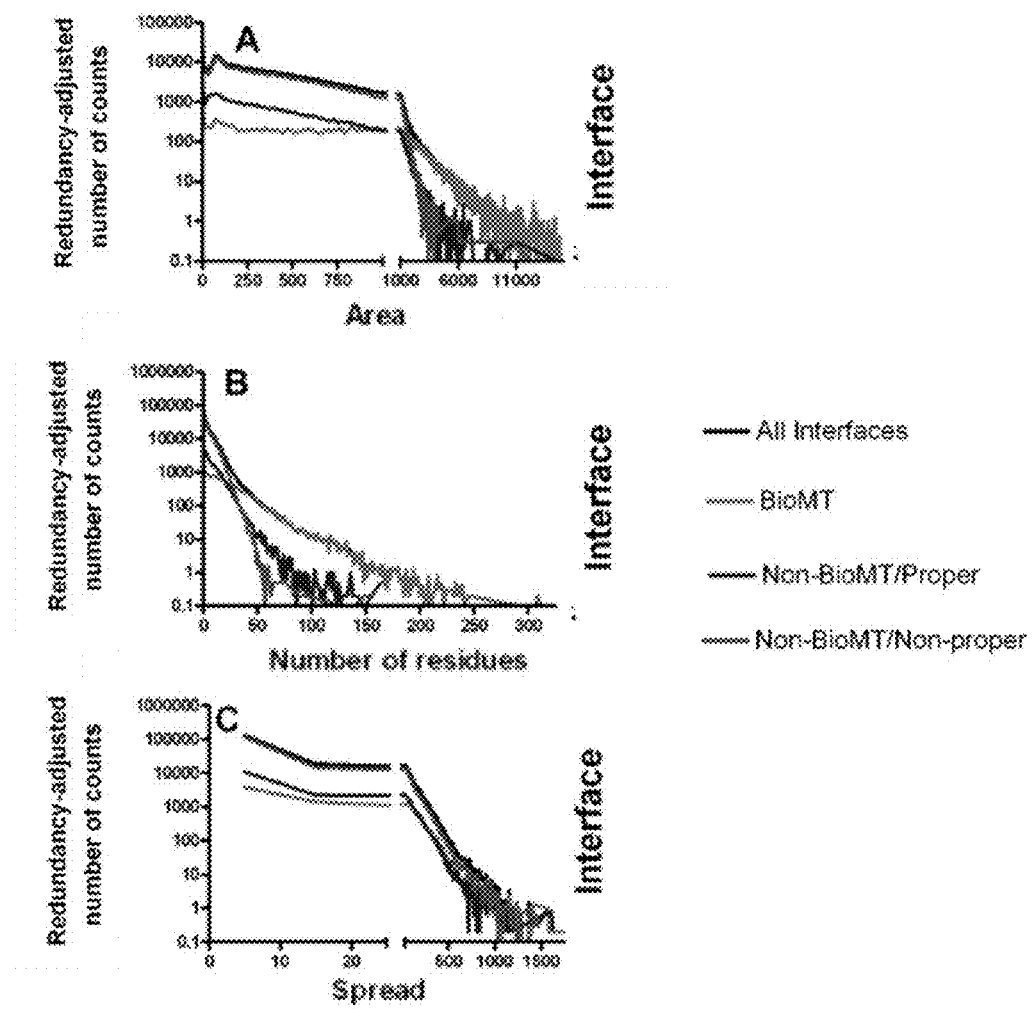
FIGURE 2A-C

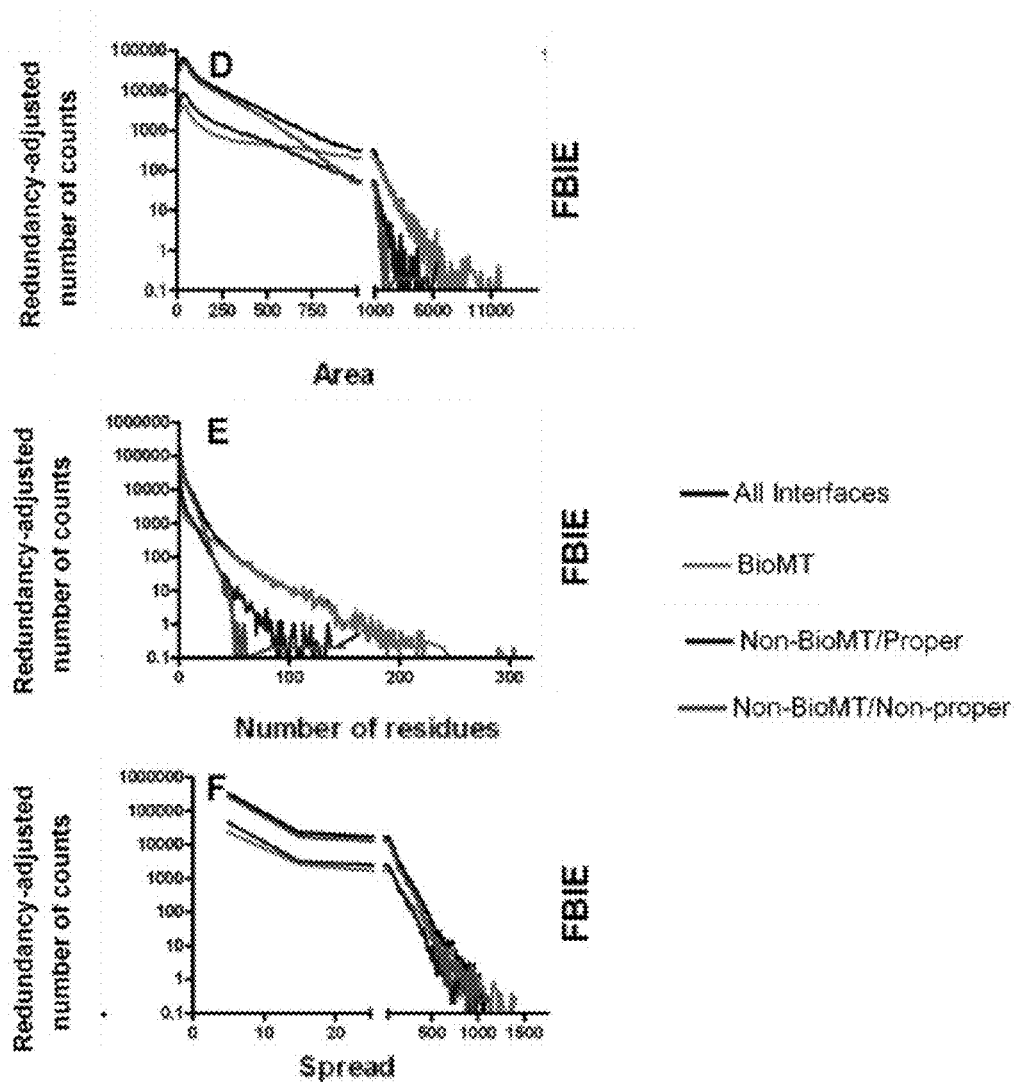
FIGURE 2D-F

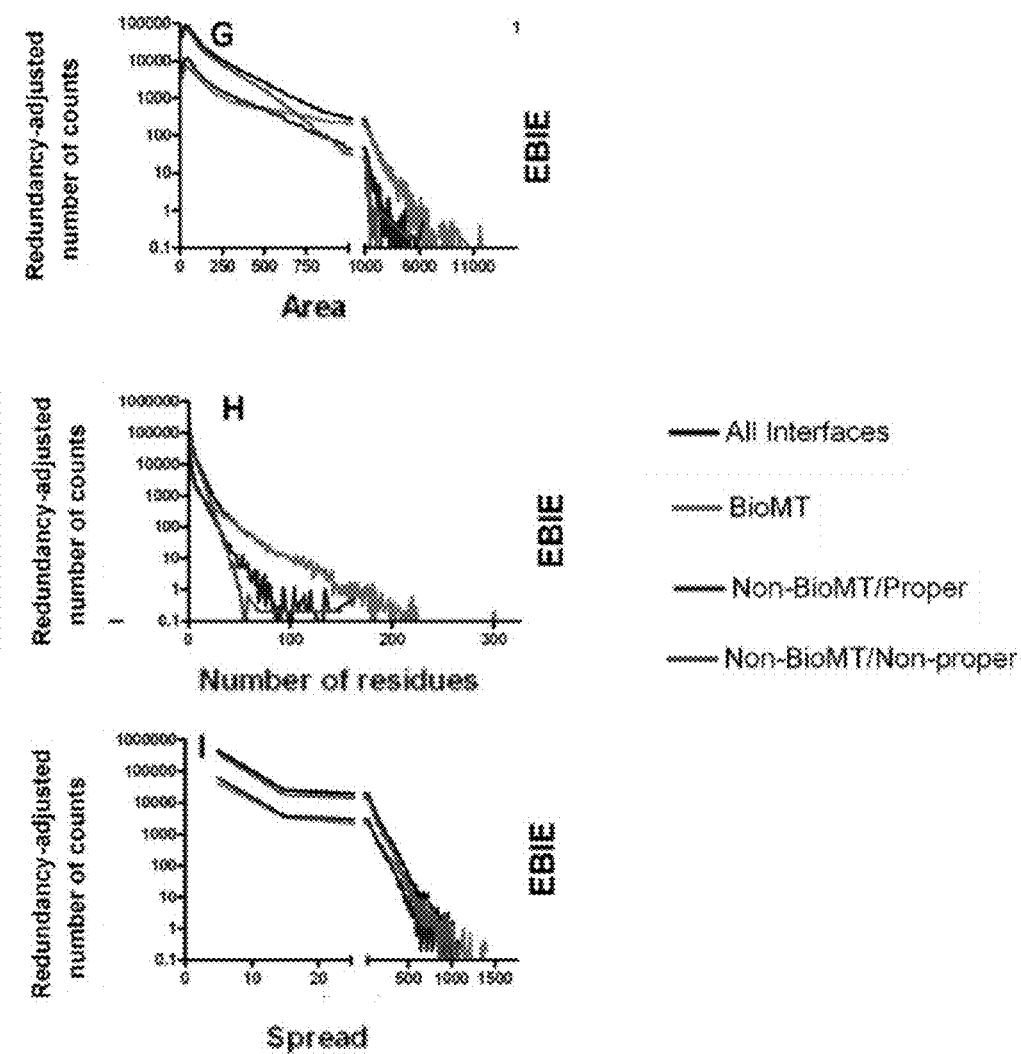
FIGURE 2G-I

Elementary Binary Interaction Epitope (EBIE): Set of residues connected by chain adjacency or intrachain interatomic contacts, all of which also have contacts with a single EBIE on a partner protein chain.

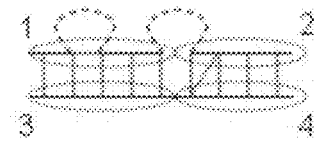

≥1

Continuous Binary Interaction Epitope (CBIE): The set of EBIE's linked by sharing residues, chain adjacency, or interatomic contacts (≤4Å) within one protein chain.

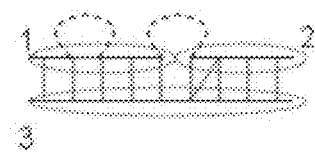

≥1

Full Binary Interaction Epitope (FBIE): The set of EBIE's linked by intrachain contacts (as in CBIE's) or interchain contacts to the partner protein chain.

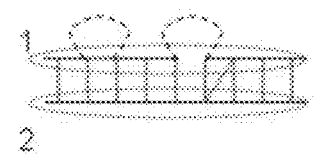

x2

Full Binary Packing Contact (FBPC): The pair of FBIE's making interprotein contacts to one another in a single interprotein pair.

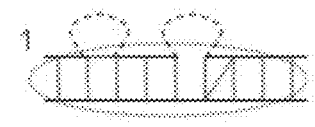

≥1

Binary Interprotein Interaction Interface: The complete set of FBPC's linking two protein chains.

FIGURE 3

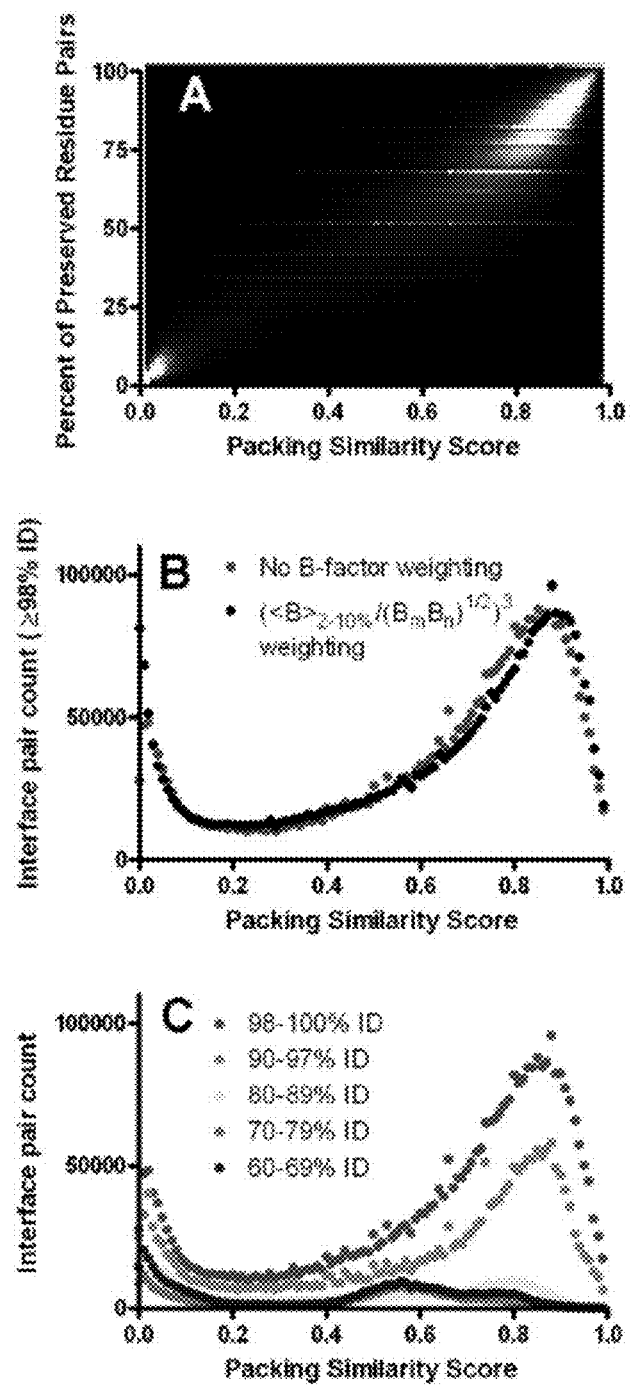
FIGURE 4A-C

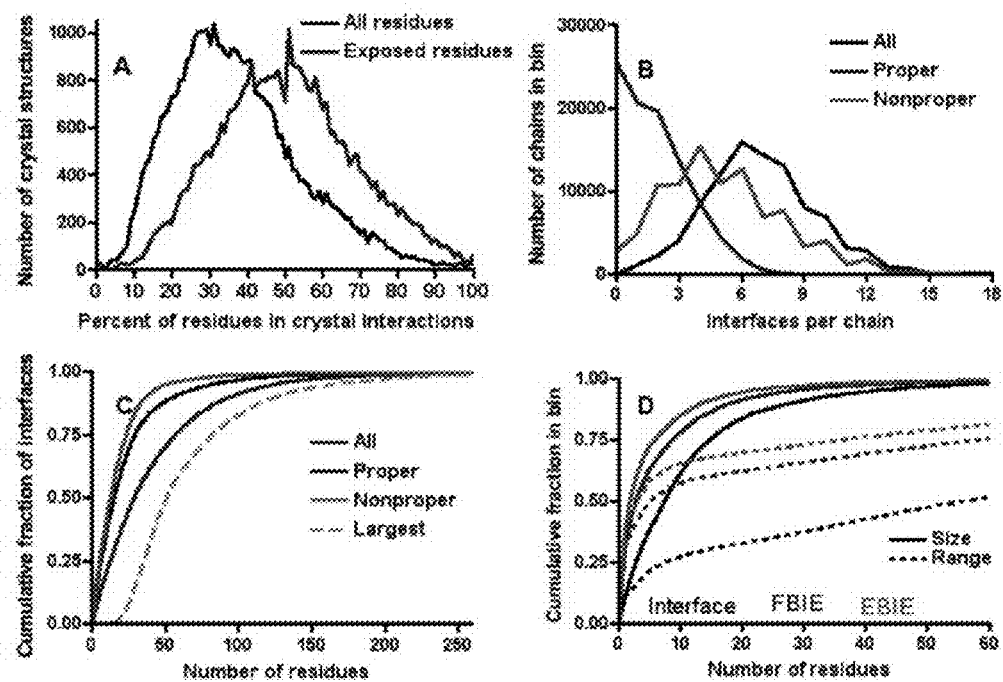
FIGURE 5A-D

| Target-ID | Target length | Mutation | Epitope (SS Mask) | Mutation Class | Polarity Change | Xtal Hits Shared w/ WT | New Xtal Hits |
|---|---|---|---|---|---|---|---|
| BhR182 | 156 | none | - | | | 33 | |
| | | F39R | TxxxxR (CCHHHH) | Helix Cap | Add charge | 7 | 38 1.8 Å |
| | | E12Y | YxxxR (HHHHH) | Helix Surface | Hydrophobic | 2 | 92 |
| ChR118 | 263 | none | - | | | 120 | |
| | | K132E | ExxR (HHHH) | Salt Bridge (i+3) | Neutral | | |
| | | S131E | ExxxR (HHHHH) | Salt Bridge | Add charge | 58 | 31 2.3 Å |
| ER40 | 292 | none | - | | | 55 | |
| | | D93K | KxxxE (HHHHH) | Salt Bridge | Neutral | 31 | 100 |
| | | L19Q | FxxxQ (HHHHH) | Helix Surface | Polar | 33 | 186 |
| | | L38E | ExxxR (HHHHH) | Salt Bridge | Add charge | 30 | 163 3.1 Å |
| | | Q245S | SAxG (HHHC) | Helix Cap | Neutral | 35 | 147 |
| MaR262 | 227 | none | - | | | 27 | |
| | | G38A | ACxxG (CCCCC) | | Hydrophobic | 6 | 3 |
| | | L48K | LxxKxY (HHHCCC) | | Add charge | 7 | 33 2.2 Å |
| | | F188E | KxxxE (HHHHH) | Salt Bridge | Add charge | 7 | 23 |
| | | F188E | KxxxE (HHHHH) | Salt Bridge | Add charge | 6 | 38 |
| SiR159 | 453 | none | - | | | 12 | |
| | | K445 | SxxG (ECCE) | Beta Turn | Remove Charge | 1 | 7 |
| | | G32H | SxxxH (HHHHH) | Helix Surface | Polar | 6 | 5 |
| | | A140L | LxxxxQ (CCHHHH) | Helix Cap | Neutral | 0 | 6 |
| VpR106 | 435 | none | - | | | 6 | |
| | | P57L | LxxxxQ (CCHHHH) | Helix Cap | Neutral | 1 | 7 |
| | | R60E/I64R | ExxxR (HHHHH) | Salt Bridge | Add charge | 1 | 4 2.1 Å |
| | | K272R | ExxxR (HHHHH) | Salt Bridge | Neutral | 2 | 6 |

FIGURE 9

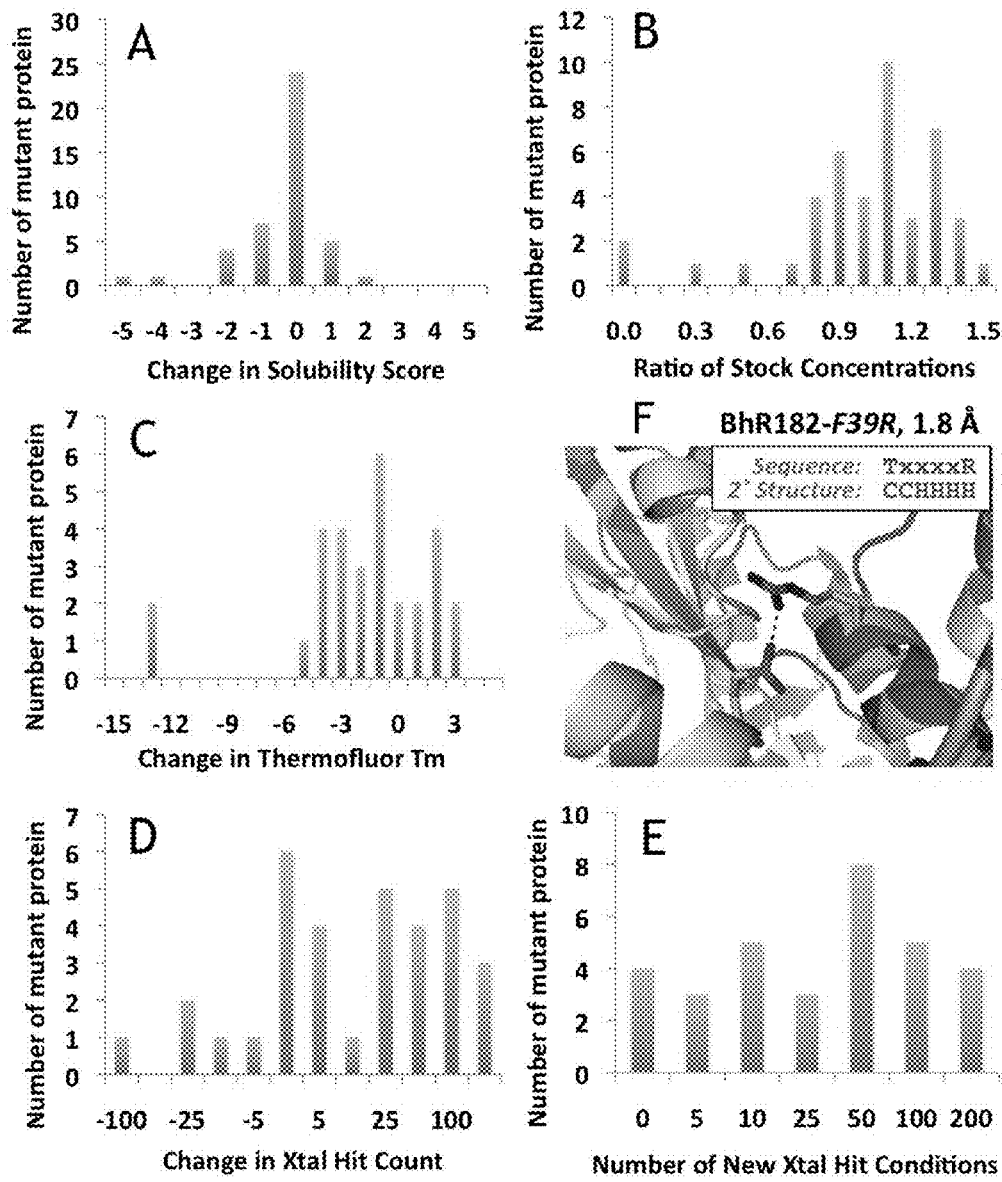
FIGURE 10A-F

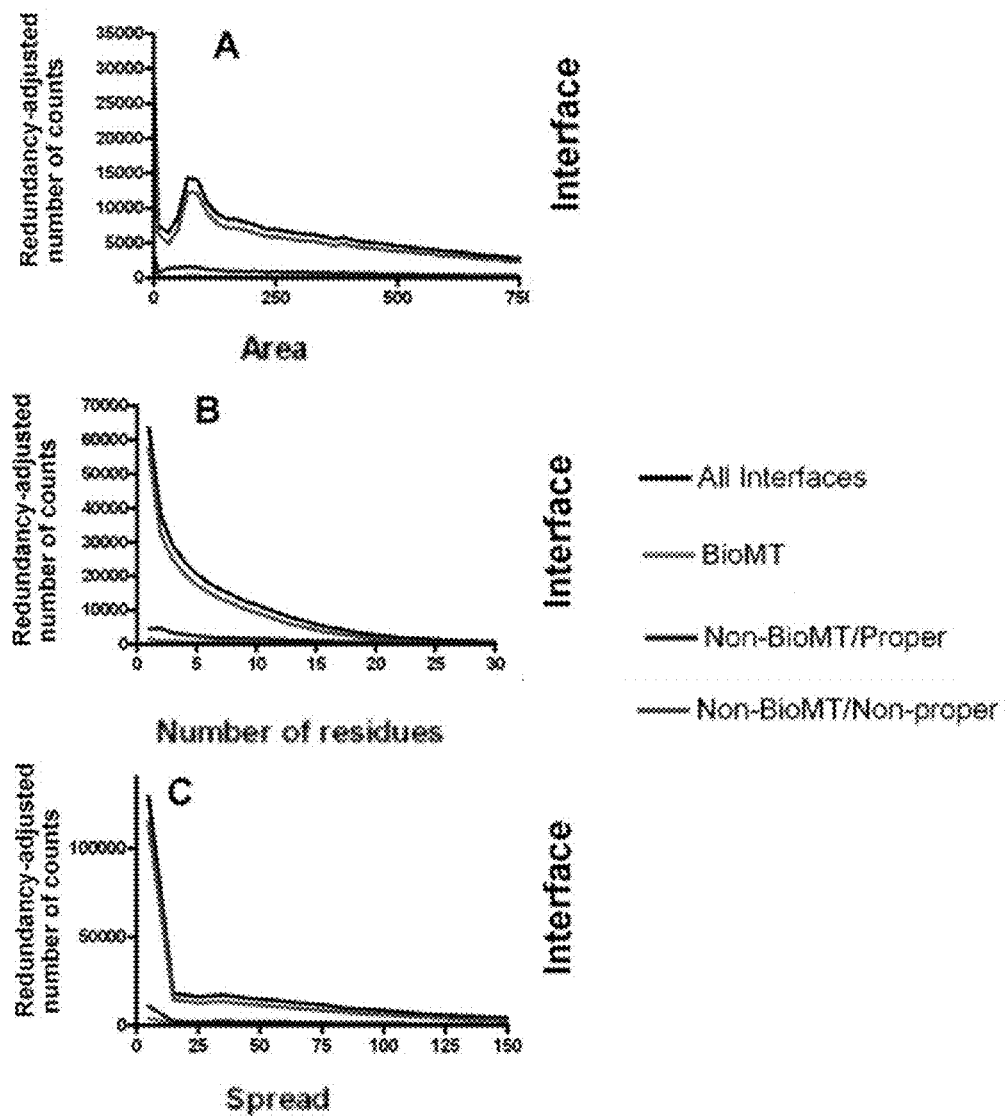
FIGURE 11A-C

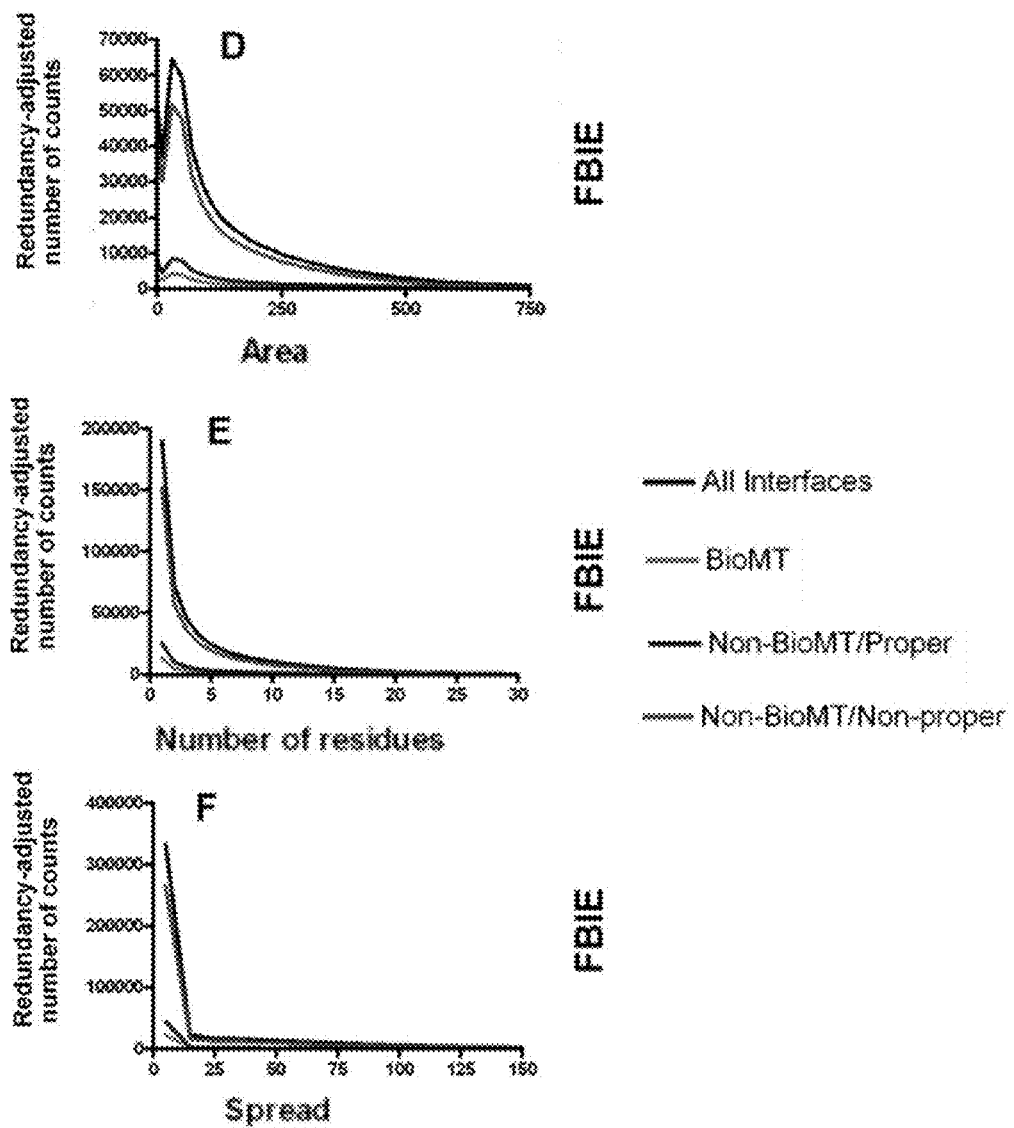
FIGURE 11D-F

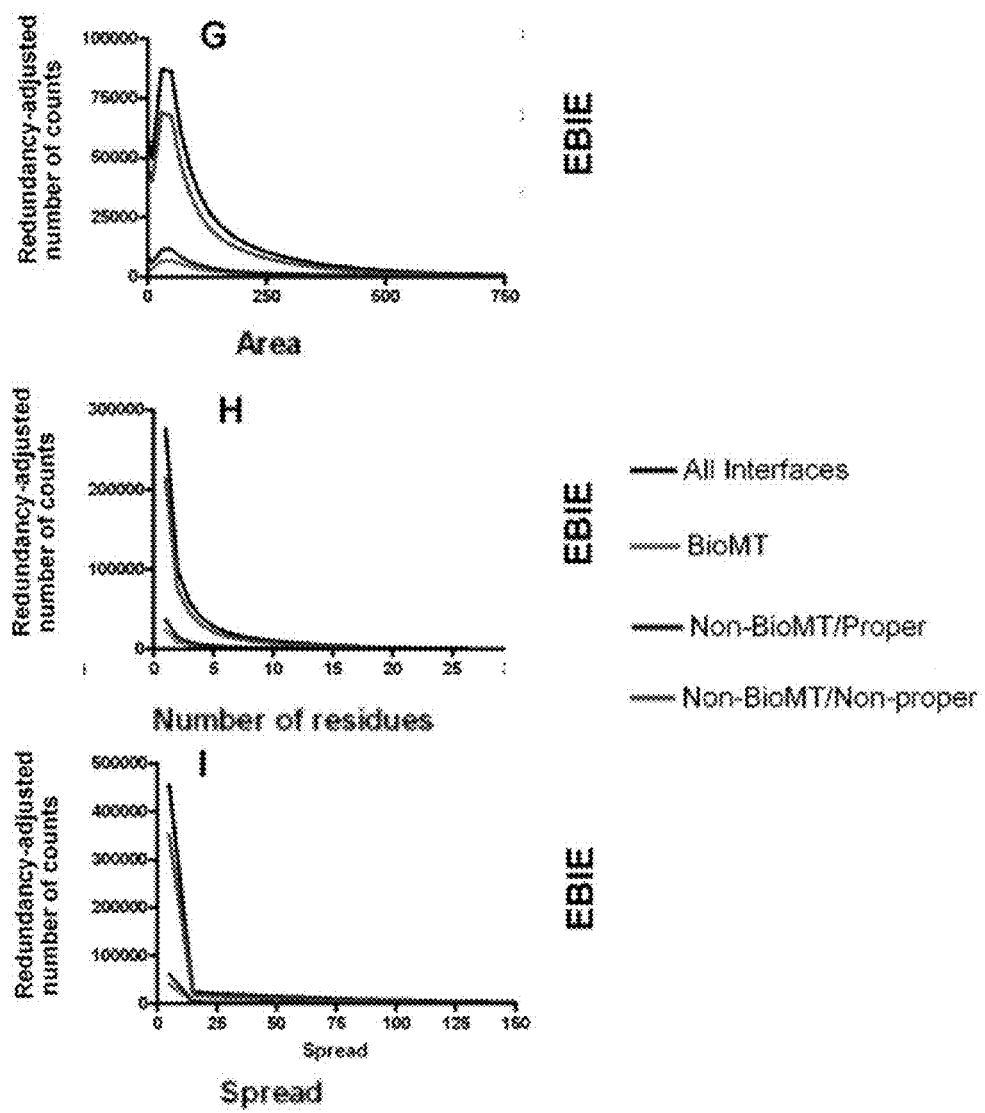
FIGURE 11G-I

ER40 hit counts in high-throughput microbatch screening at HWI (1 week)

|        | WT         | L23Q       | L38E       | D93K   | Q245S   | Tetramutant |
|--------|------------|------------|------------|--------|---------|-------------|
| WT     | 55 (26,17) | 39\74      | 40\40      | 55\1   | 45\18   | 31\109      |
| L23Q   | 74\39      | 90 (59,19) | 76\41      | 90\1   | 77\15   | 30\73       |
| L38E   | 40\40      | 41\76      | 55 (26,21) | 55\1   | 41\14   | 38\116      |
| D93K   | 1\55       | 1\90       | 1\55       | 1 (1,1)| 1\28    | 1\133       |
| Q245S  | 18\45      | 15\77      | 14\41      | 28\1   | 28 (4,1)| 14\119      |
| Tetramutant | 109\31 | 73\30      | 116\38     | 133\1  | 119\14  | 133 (-,57)  |

Diagonals show total number then, in parentheses, unique number vs. WT, all variants.

Off-diagonals indicate number of non-shared conditions for variants in the row\column.

|  | Surface-exposure profile | Redundancy-corrected count in dataset | Redundancy-corrected count in epitopes | Fraction in epitopes |  |
|---|---|---|---|---|---|
|  | SS | 2680000.0 | 690000.0 | 0.26 |  |
|  | SI | 1240000.0 | 105000.0 | 0.09 |  |
|  | IS | 1240000.0 | 111000.0 | 0.09 |  |
|  | II | 1600000.0 | 15000.0 | 0.01 |  |
| Sub-epitope amino acid pattern |  |  |  |  | Expected count in epitopes |
| GG | SS | 16900.0 | 4500.0 | 0.27 | 16,900*0.257=4,361 |
| GG | SI | 6100.0 | 750.0 | 0.12 | 6,100*0.085=518 |
| GG | IS | 4300.0 | 400.0 | 0.09 | 4,300*0.090=387 |
| GG | II | 10500.0 | 160.0 | 0.02 | 10,500*0.001=84 |
|  | Total | 37800.0 | 5810.0 | 0.15 | 5350.0 |
|  |  |  | Z=6.2 |  |  |

FIGURE 17

ENGINEERING SURFACE EPITOPES TO IMPROVE PROTEIN CRYSTALLIZATION

This application is a continuation-in-part of International Application No. PCT/US2011/33135, filed Apr. 19, 2011, which claims priority to U.S. Provisional Patent Application No. 61/325,723, filed Apr. 19, 2010, U.S. Provisional Patent Application No. 61/432,901, filed Jan. 14, 2011, the contents of each of which are hereby incorporated by reference in their entireties.

GOVERNMENT INTERESTS

This invention was made with government support under grants GM074958, GM072867, GM062413, and GM075026 awarded by the National Institutes of Health. The government has certain rights in this invention.

This patent disclosure contains material that is subject to copyright protection. The copyright owner has no objection to the facsimile reproduction by anyone of the patent document or the patent disclosure as it appears in the U.S. Patent and Trademark Office patent file or records, but otherwise reserves any and all copyright rights.

All patents, patent applications and publications cited herein are hereby incorporated by reference in their entirety. The disclosures of these publications in their entireties are hereby incorporated by reference into this application in order to more fully describe the state of the art as known to those skilled therein as of the date of the invention described herein.

SEQUENCE LISTING

The instant application contains a Sequence Listing which has been submitted in ASCII format via EFS-Web and is hereby incorporated by reference in its entirety. Said ASCII copy, created on Jan. 10, 2013, is named 192473US.txt and is 1,388,275 bytes in size.

BACKGROUND OF THE INVENTION

Current understanding of biology makes great use of atomic level protein structures, but the generation of these structures, e.g., by X-ray crystallography, is both expensive and uncertain. A significant bottleneck in the process is the generation of high quality crystals for X-ray diffraction. Much effort has gone to developing crystallization screens, and to creating high-throughput methods for cloning and expressing proteins (see, e.g., Acton T. B. et al., *Methods Enzymol.* 2005, 394, 210-243). However, the mechanisms of crystallization—and the protein characteristics that impact it—remain largely unknown and poorly understood, with different methods of study yielding substantially different results.

The Surface Entropy Reduction (SER) methods, identify mutations that can potentially improve crystallization by using secondary structure prediction and sequence conservation to locate residues with high-entropy side chains in variable loop regions of the protein. Replacing one or more of these residues with a low-entropy amino acid, like alanine, has been predicted to improve crystallization by reducing the entropic penalty of inter-protein interface formation. Moreover, this approach focuses on making mutations in predicted loop regions of the protein's secondary structure.

The methods described herein differ from the SER methods by using the Protein Data Bank (PDB) as a data mine of information to improve predictions. By using a topological analysis of crystal structures in the PDB, this is a novel approach to identifying possible mutations to improve crystallization. The methods described herein are superior as information is culled for improving interface formation from interfaces already experimentally observed. Moreover, unlike the SER methods, the methods and systems described herein use whole epitope modifications, rather than single amino acid changes, thus increasing the success rate at which an inter-protein interface could be formed, since interfaces are usually comprised of a surface and not a single residue interaction.

The epitope modifications involve chemical changes of very diverse types, including hydrophobic-to-hydrophilic substitutions in equal measure to hydrophilic-to-hydrophobic mutations, whereas the single-residue mutations suggested by SER involves primarily hydrophilic-to-hydrophobic substitutions and almost always polarity-reducing mutations. Such mutations tend to impair solubility, which prevents effective protein purification and crystallization. The greater diversity in the kinds of chemical changes involved in epitope modification fundamentally frees crystallization engineering from the crippling correlation between crystallization-improving and solubility-impairing mutations. Epitope modifications frequently involve increasing the side-chain entropy, so they do not require entropy reduction at the level of individual amino acids, which is the foundation of the SER method.

Finally, SER methods avoid mutations for non-loop regions of the protein, missing out on many potential epitopes in α-helices, helix capping motifs, or beta hairpins. The epitope engineering method described herein includes all secondary structure elements, thus generating a larger computational list of possible epitope candidates.

SUMMARY OF THE INVENTION

The invention is based, in part, on the finding that replacement of certain epitopes in a protein with more desirable epitopes, some of which occur in non-loop regions of the protein, significantly improves crystallization properties of the protein for purposes of X-ray crystallographic studies.

It is understood that any of the embodiments described below can be combined in any desired way, and any embodiment or combination of embodiments can be applied to each of the aspects described below.

In one embodiment, the invention provides for a method of modifying a protein sequence for high-resolution X-ray crystallographic structure determination, the method comprising: (a) receiving a sequence of a protein of interest; (b) selecting, using a computer, an epitope from an epitope library that is expected to increase the propensity of the protein of interest to crystallize and that is consistent with sequence variations observed in homologous proteins; and (c) outputting information on which portion of the amino acid sequence of the protein of interest should be replaced with the selected epitope to generate a modified protein.

In another embodiment of the invention, the information is outputted in the form of an amino acid sequence of the modified protein or a portion thereof. In another embodiment of the invention, the information is outputted in the form of a list of mutations to be made in the amino acid sequence of the protein of interest to provide the amino acid sequence of the modified protein or a portion thereof. In some embodiments, the information is outputted in the order that is a function of its likelihood of improving crystallization of the target protein.

In some embodiments, the epitope library includes information describing over-representation of an epitope in the PDB database.

In another embodiment of the invention, the method further comprises predicting the secondary structure of the protein of interest and of its homolog. In another embodiment, the method further comprises identifying a homolog of the protein of interest and aligning the sequence of the protein of interest with the sequence of the homolog.

In one embodiment, the epitope is selected based on one or more of: over-representation P-value for overrepresentation of the epitope in the epitope library; fraction of occurrences of the epitope in the PDB database in crystal-packing contacts; frequency of occurrence of the epitope in crystal-packing interfaces in the PDB database; sequence diversity of proteins containing the epitope in crystal-packing interfaces in the PDB database; sequence diversity of partner epitopes in the PDB database; low frequency of non-water bridging ligands to the epitope in the PDB database; lack of increase in hydrophobicity of the modified protein by introducing the epitope; or predicted influence of the epitope on the solubility of the modified protein.

In another embodiment, the selected epitope is 1-6 amino acid in length. In yet another embodiment, the selected epitope is 2-15 amino acids in length. In still another embodiment, the selected epitope is 4-15 amino acids in length. In another embodiment, the selected epitope is 4-6 amino acids in length.

In a further embodiment, the epitope includes a polar amino acid. In another embodiment of the invention, the selected epitope is an epitope from Tables 5-38 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance). In another embodiment, the selected epitope is an epitope from Tables 2-3. In yet another embodiment, the selected epitope is an epitope from other tables generated using equivalent computational approaches to those described herein with obvious modification consistent with the concepts and principles described herein.

In another embodiment, the invention provides for the method where two or more steps are performed using a computer. In another embodiment, the method is implemented by a web-based server.

In a further embodiment, the invention provides for generating a nucleic acid sequence encoding a protein comprising the modified protein. The invention also provides for a method further comprising expressing the modified protein in a cell or in an in vitro expression system. In another embodiment, the method further comprises crystallizing the modified protein of interest.

In one aspect, the invention provides for a system for designing a modified protein for high-resolution X-ray crystallographic structure determination, the system comprising a computer having a processor and computer-readable program code for performing the method of modifying a protein sequence for high-resolution X-ray crystallographic structure determination, the method comprising: (a) receiving a sequence of a protein of interest; (b) selecting, using a computer, an epitope from an epitope library that is expected to increase the propensity of the protein of interest to crystallize and that is consistent with sequence variations observed in homologous proteins; and (c) outputting information on which portion of the amino acid sequence of the protein of interest should be replaced with the selected epitope to generate a modified protein.

The invention also provides for a method of using the system to obtain the amino acid sequence of the modified protein. The invention also provides for a method or a system further comprising generating a nucleic acid sequence encoding a protein comprising the modified protein. The invention also provides a method further comprising expressing the modified protein in a cell or in an in vitro expression system. In another embodiment, the invention provides for a method further comprising crystallizing the modified protein.

In another aspect, the invention provides for a computer readable medium containing a database of a plurality of epitopes from Tables 2-3 and 5-38 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance) or other tables generated using equivalent computational approaches to those described herein. In some embodiments, the computer readable medium contains a database of at least 100 epitopes from Tables 2-3 and 5-38 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance). In yet another aspect, the invention provides for a computer readable medium containing information describing over-representation of a plurality of epitopes in the PDB database. In some embodiments, the computer readable medium is non-transitory.

In yet another aspect, the invention provides for a recombinant protein in which a portion of its amino acid sequence has been replaced by an epitope from Tables 2-3 and 5-36 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance) or from other tables generated using equivalent computational approaches to those described herein. In still another aspect, the invention provides for a crystal of the protein of interest which is obtained using the methods of the invention. In one embodiment, the crystal is suitable for high-resolution X-ray crystallographic studies.

In one embodiment, the expression system is an in vitro expression system. In another embodiment, the in vitro expression system is a cell-free transcription/translation system. In still another embodiment, the expression system is an in vivo expression system. In yet another embodiment, the in vivo expression system is a bacterial expression system or a eukaryotic expression system. In another embodiment, the in vivo expression system is an *Escherichia coli* cell. In still another embodiment, the in vivo expression system is a mammalian cell.

In one embodiment, the protein of interest is a human polypeptide, or a fragment thereof. In another embodiment, the protein of interest is a viral polypeptide, or a fragment thereof. In another embodiment, the protein of interest is an antibody, an antibody fragment, an antibody derivative, a diabody, a tribody, a tetrabody, an antibody dimer, an antibody trimer or a minibody. In another embodiment, the protein of interest is a target of pharmaceutical compound or a receptor. In still another embodiment, the antibody fragment is a Fab fragment, a Fab' fragment, a F(ab)$_2$ fragment, a Fd fragment, a Fv fragment, or a ScFv fragment. In yet another embodiment, the protein of interest is a cytokine, an inflammatory molecule, a growth factor, a cytokine receptor, an inflammatory molecule receptor, a growth factor receptor, an oncogene product, or any fragment thereof. In another yet another embodiment, the protein of interest is a fusion polypeptide. In one aspect, the invention described herein relates to a protein of interest produced by the methods described herein. In one aspect, the invention described herein relates to a pharmaceutical composition comprising the protein of interest produced by the methods described herein. In one aspect, the invention described herein relates to an immunogenic composition comprising the protein of interest produced by the methods described herein.

In one aspect, the invention provides for the use of packing epitopes from previously determined X-ray crystal structures in engineering of proteins with improved crystallization properties.

BRIEF DESCRIPTION OF THE FIGURES

FIG. 2 shows characteristics of oligomeric vs. crystal packing interfaces. Distributions are shown for three levels of interaction classification: half-interfaces (FIG. 2A, FIG. 2B, and FIG. 2C), full binary interaction epitopes (FIG. 2D, FIG. 2E, and FIG. 2F), and elementary binary interaction epitopes (FIG. 2G, FIG. 2H, and FIG. 2I). Distributions show the number of counts of the relevant element binned by buried surface area (FIG. 2A, FIG. 2D, and FIG. 2G), number of participating residues (FIG. 2B, FIG. 2E, and FIG. 2H), and spread—the number of residues, interacting or not, spanned by the element (FIG. 2C, FIG. 2F, and FIG. 2I). Within each graph, separate distributions are shown for all elements, elements which appear in the BioMT database of inferred biological oligomers, elements which do not appear in BioMT but are within proper interfaces, and elements which do not appear in BioMT and are not proper interfaces. All counts are redundancy-culled.

FIG. 3 is a graphical representation of the analytical scheme for crystal-packing analysis. Definitions of elements in the packing interface are given next to schematic depictions of each element. Bold lines represent protein chains, grey lines inter-atomic contacts ≤4 Å, and numbered circles show representative elements.

FIG. 4 shows polymorphism in crystal packing interactions. FIG. 4A: Color-ramped 2-dimensional histogram for 3,185,367 pairs of interfaces from crystal structures of proteins with ≥98% sequence identity showing the percentage of pairwise residue interactions conserved versus the PSS (packing similarity score, defined as the Frobenius product of the contact or interaction matrices). FIG. 4B: Histogram of PSSs for these interfaces calculated either without B-factor weighting (n=0) or with high B-factor residues down-weighted (n=3) as described in the text. FIG. 4C: Histogram of unweighted PSSs (packing similarity score, defined as the Frobenius product of the contact or interaction matrices) for non-proper interfaces formed by proteins with different levels of sequence identity.

FIG. 5 is a graphical representation of summary statistics on all interfaces in 39,208 protein crystal structures in the PDB. (A) Histograms showing distributions of the fraction of residues participating in inter-protein packing contacts. (B) Histograms showing number of interfaces per crystal. (C) Cumulative distribution graph showing fraction of interfaces equal to or smaller in size than the number indicated on the abscissa. In this graph, residues from the two interacting molecules are counted separately. The curve labeled "Largest" shows data for the single largest non-proper interface in each crystal. (D) Cumulative size and range distributions for hierarchically defined packing elements (counting residues from one of the interacting molecules).

FIG. 9 shows epitope-engineering of proteins giving intractable crystals. FIG. 9 discloses SEQ ID NOS 89-90, 415, 50, 96-97, 50, 99, 105, 107-108, 108, 110, 112-113, and 115-117, respectively, in order of appearance.

FIG. 10 shows the results from preliminary epitope-engineering experiments. 36 single epitope mutations were designed in nine proteins. Subsequently, pairs or triplets of these were combined to make five proteins bearing multiple epitope mutations. These 41 protein variants harboring single and multiple epitope mutations were purified and screened for crystallization using the NESG pipeline. FIG. 10A: Differences in soluble yield in *E. coli* compared to corresponding WT protein, as scored on a standard 0-5 scale[33]. FIG. 10B: Ratio of crystallization stock concentrations compared to WT protein. FIG. 10C: Difference in Thermofluor $T_m$ for 30 single mutants. FIG. 10D: Change in number of crystallization hits compared to WT four weeks after set up in the 1536-well robotic screen at the Hauptman-Woodward Institute. FIG. 10E: Number of unique crystallization conditions in this screen in which the epitope mutant gave a hit while the WT did not. FIG. 10F: Crystal-packing contact involving the mutated F39R residue in the 1.8 Å crystal structure of NESG target BhR182. FIG. 10F discloses "TxxxxR" as SEQ ID NO: 89.

FIG. 11 A-I shows redundancy-adjusted number of counts for Interface, FBIE, and EBIE.

FIG. 14 shows that epitope mutations open up a new dimension in exploration of crystallization space. The first number in each diagonal cell shows the total number of conditions in which crystals ("hits") were observed for each protein variant. The numbers in parentheses in these cells indicate the number of unique chemical conditions giving hits for that variant compared to, first, the WT protein and, second, all other mutant variants evaluated. The off-diagonal cells show the number of hit conditions for the variants on the row and the column that were not shared with one another (i.e., first for the protein on the row and second for the one on the column).

FIG. 15 shows the results of an epitope-engineering study on four "no hits" proteins, i.e., proteins that yielded no crystallization hits in two independent screens of the protein with wild type sequence. The results show that crystal structures were solved for two of these four proteins using 4-5 single eptitope mutations per protein. FIG. 15 discloses SEQ ID NOS 5,228-5,231, respectively, in order of appearance.

FIG. 17 shows "surface-shaping" to calibrate expectations for participation in crystal-packing interactions.

DETAILED DESCRIPTION OF THE INVENTION

Figure 1:
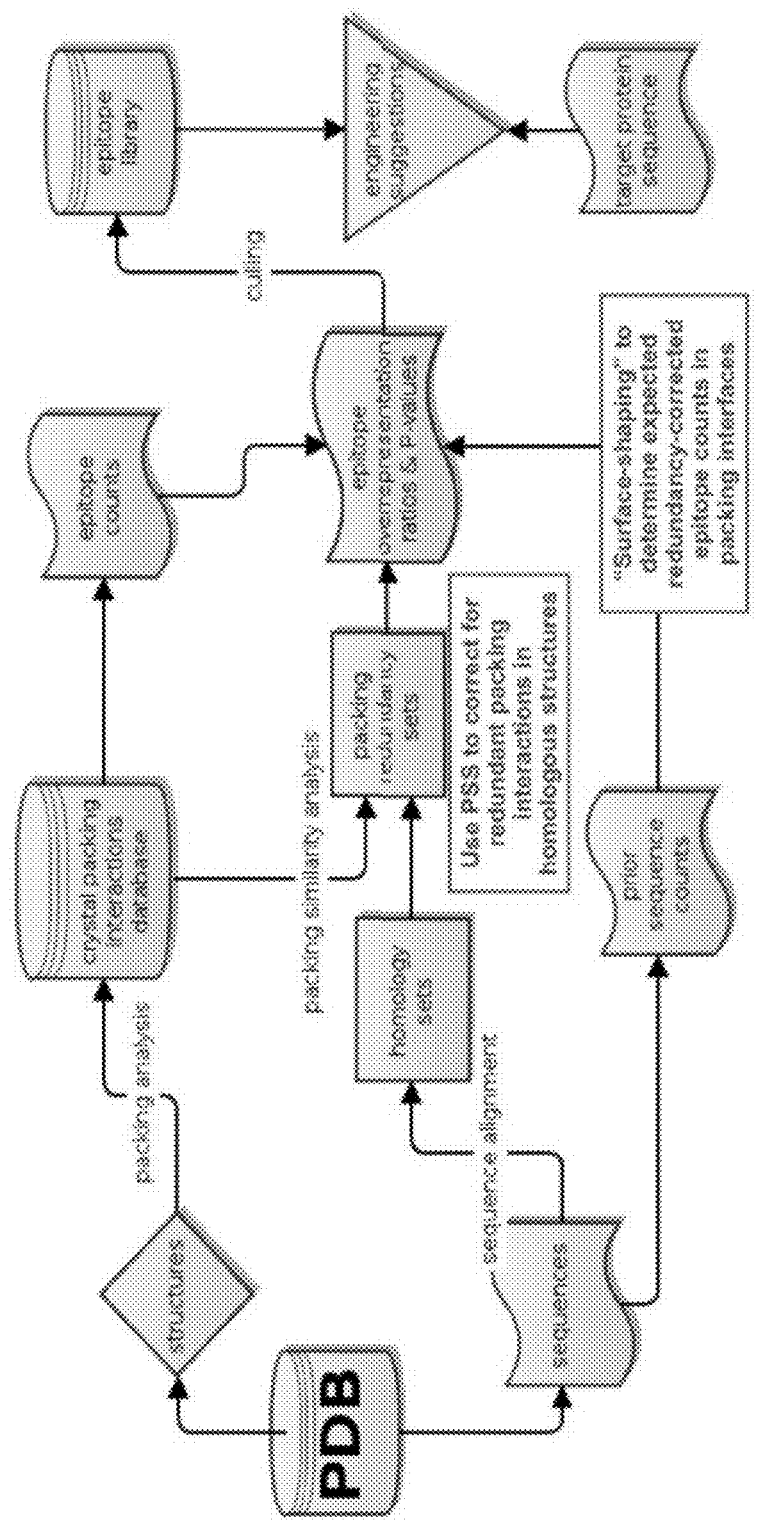
FIG. 1 is a diagram of epitope library generation according to one embodiment of the invention.

The issued patents, applications, and other publications that are cited herein are hereby incorporated by reference to the same extent as if each was specifically and individually indicated to be incorporated by reference.

Research on the crystallization of proteins substantially predated efforts to determine their atomic structures using diffraction methods. Despite the historical importance of avidly crystallizing proteins, most proteins do not produce high-quality crystals. Even for proteins with the most promising sequence properties, at most ⅓ yield crystal structures from a single construct. These include the development of efficacious chemical screens that mimic historically successful crystallization conditions, sophisticated robots that enable more crystallization conditions to be screened with less protein and effort, and numerous innovations that improve crystallization in some cases. However, as long as most proteins cannot be crystallized, crystallization fundamentally remains a hit-or-miss proposition.

Existing methods for improving protein crystallization work with limited efficiency. Consistent with this premise, changes in primary sequence have been demonstrated to alter substantially the crystallization properties of many proteins. Disordered backbone segments can be identified using elegant hydrogen-deuterium exchange mass spectrometry methods, and constructs with such segments excised have shown improved crystallization properties. Progressive truncation of the N- and C-termini of the protein can also yield crystallizable constructs of proteins that initially failed to crystallize. However, many nested truncation constructs generally need to be screened, sometimes with termini differing by as little as two amino acids; even after extensive effort, this procedure still frequently fails to yield a soluble protein construct producing high-quality crystals. The Surface Entropy Reduction (SER) method uses site-directed mutagenesis to replace high-entropy side chains on the surface of the protein (generally lys, glu, and gln) with lower entropy side chains (generally ala). In most cases in which a substantial improvement in crystallization has been obtained by this method, a pair of mutations was introduced at adjacent sites. While some successes have been obtained, most such mutations reduce the solubility of the protein, frequently so severely that it prevents effective protein purification.

Analyses of large-scale experimental studies show that the surface properties of proteins, and particularly the entropy of the exposed side chains, are a major determinant of protein crystallization propensity[4]. Such studies demonstrated that overall thermodynamic stability is not a major determinant of protein crystallization propensity. They also identified a number of primary sequence properties that correlate with crystallization success, including the fractional content of several individual amino acids (i.e., gly, ala, and phe). Equivalent methods have been used to assess correlations between protein sequence properties and expression/solubility results (Price et al., 2011, Microbial Informatics and Experimentation, 1:6, doi:10.1186/2042-5783-1-6). These studies demonstrated that the individual amino acids that positively correlate with crystallization success negatively correlate with protein solubility, and vice versa. This effect severely limits the efficacy of single amino acid substitutions in improving protein crystallization because crystallization probability is low unless starting with a monodisperse soluble protein preparation. Therefore, more sophisticated approaches than single amino-acid substitutions are needed for efficient engineering of improved protein crystallization.

The methods described herein related to methods for improving protein crystallization by the introduction of complex sequence epitopes that mediate high-quality packing contacts in crystal structures deposited into the Protein Data Bank (PDB).

In certain aspects, the invention relates to the finding that many naturally occurring proteins have excellent solubility properties and also crystallize very well. In certain aspects, the invention relates to the finding specific protein surface epitopes that can mediate strong interprotein interactions under the conditions that drive protein crystallization without compromising solubility in the dilute aqueous buffers used for purification. Described herein are such epitopes as well as methods for finding such epitopes and using them to engineer crystallization of otherwise crystallization-resistant proteins. In certain aspects, the invention described herein relates to linear sequence epitopes contributing to interface formation in existing protein crystal structures. The methods described herein can be used to rank the packing quality and potential of these epitopes based on statistical analyses of epitope prevalence and properties combined with molecular-mechanics analyses of interfacial and intramolecular packing energies. Such rankings can be used to prioritize epitopes for systematic experimental evaluation of their potential to improve the crystallization properties of otherwise crystallization-resistant proteins.

As used herein, the recitation of a numerical range for a variable is intended to convey that the invention may be practiced with the variable equal to any of the values within that range. Thus, for a variable that is inherently discrete, the variable can be equal to any integer value within the numerical range, including the end-points of the range. Similarly, for a variable that is inherently continuous, the variable can be equal to any real value within the numerical range, including the end-points of the range. As an example, and without limitation, a variable which is described as having values between 0 and 2 can take the values 0, 1 or 2 if the variable is inherently discrete, and can take the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The singular forms "a," "an," and "the" include plural references unless the content clearly dictates otherwise. Thus, for example, reference to "an epitope" includes a plurality of such epitopes.

An "epitope," as used herein, is as a specific sequence of amino acids with a specific secondary-structure pattern that makes intermolecular packing contacts. The term "epitope" includes a "sub-epitope" which is also called an "epitope subsequence" herein. In some embodiments, the term "epitopes" encompasses Elementary Binary Interaction Epitopes (EBIEs).

An "epitope subsequence" or a "sub-epitope", as used herein, is a sequence within an "epitope", i.e., within a specific pattern of amino acids with a specific secondary-structure pattern that makes intermolecular packing contacts. For example, the ExxxR (SEQ ID NO: 50)/HHHHH epitope subsequence contains Glu and Arg making packing contacts at positions four residues apart in a continuous segment of α-helix.

The term "polar amino acid" includes serine (Ser), threonine (Thr), cysteine (Cys), asparagine (Asn), glutamine (Gln), histidine (His), lysine (Lys), arginine (Arg), aspartic acid (Asp), and glutamic acid (Glu).

The term "hydrophobic amino acid" includes glycine (Gly), alanine (Ala), valine (Val), leucine (Leu), isoleucine (Ile), proline (Pro), phenylalanine (Phe), methionine (Met), tryptophan (Trp), and tyrosine (Tyr).

As used herein, EBIE(s) refers to Elementary Binary Interaction Epitope(s), CBIE refers to Continuous Binary Interaction Epitopes(s), and FBIE(s) refers to Full Binary Interaction Epitope(s).

In certain aspects, the methods described herein are based on a new approach to engineering improved protein crystallization based on introduction of historically successful crystallization epitopes and sub-epitopes into crystallization-resistant proteins. In certain aspects, the methods described herein relate to the results of data mining high-throughput experimental studies. This analysis showed that crystallization propensity is controlled primarily by the prevalence of low-entropy surface epitopes capable of mediating high-quality crystal-packing interactions. The PDB contains an archive of such epitopes in deposited crystal structures; however, other databases can be used according to the methods described herein. Computational methods can be used in connection with the methods described herein to identify and analyze all crystal-packing epitopes in the PDB. In certain aspects, the invention relates to metrics useful for ranking the efficacy of packing epitopes in order to identify those with a high probability of forming energetically favorable interactions under the low water-activity conditions used to drive crystallization. For example, such metric can include, but are not limited to statistical over-representation of each epitope in packing interactions with diverse partner sequences in the PDB. However, other ranking strategies are suitable for use with the methods described herein, including, but not limited to, using molecular mechanics calculations to estimate inter-molecular packing energy. In certain aspects, the methods described herein can be used to engineer the surface of a protein to be enriched in epitopes with favorable packing potential that will promote formation of a well-ordered 3-dimensional lattice. When the packing interfaces in some regular lattice have favorable free energy, the formation of that lattice is favored thermodynamically due to the consistent gain in energy for every added molecule. Thus, in certain aspects the invention described herein relates to the prevalence of surface epitopes with high propensity to form such favorable interactions, which will influence whether a protein can find a lattice structure with favorable intermolecular interactions or whether it precipitates amorphously with heterogeneous interactions. In certain aspects, the invention relates to the finding that increasing the prevalence of surface epitopes with favorable packing potential increases high quality crystallization.

Generation of a Library of Epitopes that are Expected to Improve Crystallization Properties of a Target Protein In some embodiments, a database is generated containing a library of all elementary, continuous, or full binary interaction epitopes (EBIEs, CBIEs, and FBIEs) in the PDB that span at most two successive regular secondary structural elements and flanking loops (as identified by the DSSP algorithm (Kabsch and Sander, *Dictionary of protein secondary structure: pattern recognition of hydrogen-bonded and geometrical features. Biopolymers* 22 (12), 2577-637 (1983)).

An interface is defined as all residues making atomic contacts ($\leq 4$ Å) between two protein molecules related by a single rotation-translation operation in the real-space crystal lattice. The interface is decomposed into features called Elementary Binary Interaction Epitopes (EBIEs). These comprise a connected set of residues that are covalently bonded or make van der Waals interactions to one other in one molecule and that also contact a similarly connected set of residues in the other molecule forming the interface. EBIEs can be the foundation of this analysis because these features and their constituent sub-features represent potentially engineerable sequence motifs. One or more EBIEs that are connected to one another by covalent bonds or van der Waals interactions within a molecule form a Continuous Binary Interaction Epitope (CBIE). One or more CBIEs in one molecule that are connected to one another indirectly by a chain of contacts across a single interface form a Full Binary Interaction Epitope (FBIE). The set of one or more FBIEs that all mediate contacts between the same two molecules in the real-space lattice form a complete interface.

The sequence of both contacting and non-contacting residues is stored along with the standard DSSP-encoding of the secondary structure at each position in the protein structure in which the epitope was observed to mediate a crystal-packing interaction. All metrics possibly related to the crystal-packing potential of the epitope are recorded, including B-factor distribution parameters, statistical enrichment scores relative to all interfaces in the PDB, as well as conservation in multiple crystals from homologous proteins, and crystallization propensity and solubility scores based on the sequence composition of the epitope. The database includes the identity of all EBIE pairs making contact with each other as well as a breakdown of the composition of all FBIEs and CBIEs in terms of their constituent EBIEs. This versatile resource for analyzing and engineering crystallization epitopes is available on the crystallization engineering web-server.

One embodiment of the invention which demonstrates how an epitope library can be generated is schematized in FIG. 1. A hierarchical analytical scheme has been developed to identify contiguous epitopes potentially useful for protein engineering, and has been used to analyze all inter-protein packing interactions in crystal structures in the PDB. The hierarchical scheme can be very useful for this analysis.

The PDB contain some structures that have errors which creates inaccuracies in the characterization of these structures. It also contains many structures that are partially or completely redundant that create problems in the eventual identification of sequence motifs that are over-represented in crystal-packing interactions. These concerns can be addressed by computational flagging and down-weighting mechanisms, respectively.

Biological and non-biological protein oligomers can be addressed as follows. To identify biological oligomers, the BioMT database (Krissinel and Henrick, *Inference of macromolecular assemblies from crystalline state. J. Mol. Biol.* 372, 774-797), which attempts to categorize all previously described biological interfaces in the PDB, can be used. Interfaces so identified are flagged as "BioMT" interfaces. Recognizing that some oligomeric interfaces may not be appropriately categorized by BioMT, the set of "proper" interfaces which could be either biological or crystallographic are identified.

Interfaces are designated as "proper" if they form part of a regular oligomer with proper rotational symmetry (i.e., n protein molecules in the real-space lattice each related to the next by a 360°/n rotation±5°, with n being any integer from 2-12) and "non-proper" if they do not. Proper interfaces could potentially be part of a stable physiological oligomer while non-proper interfaces cannot. After these two categorization steps, four sets of interfaces exist: the set of all interfaces; the set of biological interfaces identified by BioMT; the set of proper interfaces not identified as biological interfaces by BioMT, but which could potentially be either biological or crystallographic; and the set of interfaces which are not identified by BioMT and which are not proper, as defined above. The most conservative approach to isolating non-physiological crystal-packing interactions is to focus exclusively on non-proper interfaces in order to exclude any complex that is potentially a physiological oligomer. Nonetheless, epitopes that contribute to stabilizing physiological oligomers may still be useful for engineering purposes, and epitopes that promote formation of a regular oligomer would be particularly useful because stable oligomerization strongly promotes crystallization (Price et al., *Understanding the physical properties that control protein crystallization by analysis of large-scale experimental data. Nat Biotechnol* 27 (1), 51-7 (2009)).

FIG. 2 illustrates characteristics of oligomeric vs. crystal-packing interfaces. Distributions are shown for three levels of interaction classification: half-interfaces (A, B, and C), full binary interaction epitopes (D, E, and F), and elementary binary interaction epitopes (G, H, and I). Distributions show the number of counts of the relevant element binned by buried surface area (A, D, and G), number of participating residues (B, E, and H), and spread—the number of residues, interacting or not, spanned by the element (C, F, and I). Within each graph, separate distributions are shown for all elements, elements which appear in the BioMT database of biological oligomers, elements which do not appear in BioMT but are within proper interfaces (as defined above), and elements which do not appear in BioMT and are not proper interfaces. All counts are redundancy-culled as described below. PSS is the Packing Similarity Score, and can be calculated as discussed further below.

One approach to redundancy reduction of epitope counts is described herein. Starting with all interfaces (FIG. 3) found in the analyzed set of 39,208 crystal structures, select all non-pathological protein crystals based on exclusion of those with pathologically close intermolecular packing.

Cull-1: Select non-redundant crystals: PSS<0.5 for any pair of crystals (comparing all chains).

Cull-2: Select non-BioMT interfaces, i.e., not related by PDB-designated BioMT transformation.

Cull-3: Select non-redundant interfaces within each crystal, i.e., with PSS<0.5 for any pair of interfaces within each crystal.

Cull-3': Select non-redundant interfaces between crystals, i.e., with PSS<0.5 for any pair of interfaces included in the analyses, even those in different crystals.

Count unique chain sequences contributing to Cull-3 at the 25% identity level (i.e., the number of protein chains without any pair having greater than or equal to 25% identity to one another).

Even when all biological and oligomeric interfaces are removed from the dataset, significant redundancy remains within the PDB. Many proteins in the PDB have had multiple crystal structures deposited, which may have very similar if not identical packing interactions (e.g., multiple mutations at a non-interacting active site) but which can also have completely separate packing interactions (e.g., crystallization under different conditions into a different crystal form). Simply culling identical or homologous proteins would remove all redundancy but would also eliminate significant information from the second situation, where the same protein forms crystals with different packing interactions.

To implement a redundancy down-weighting, the Packing Similarity Score (PSS) has been developed to evaluate the similarity between inter-protein interfaces, full chain interactions, and crystals. PSS can be calculated in the following way: Interactions matrices are generated for each interface, with rows representing residues in one chain and columns representing residues in the other chain. Cells in the matrix include the number of inter-atomic contacts between the two residues (including contacts mediated by a single solvent molecule) and the B-factor-derived weight associated with that contact. The PSS between two interfaces is defined as the normalized Frobenius product (a matrix dot-product) of the two interaction matrices, which are aligned to one another based on standard methods for aligning homologous protein sequences, as described below. The PSS takes values in the range between 0 and 1. This value contains significant information about the overall similarity of two interfaces, and is sensitive to small changes (FIG. 4A). To calculate the PSS for two chains or two crystals, the process is essentially repeated on a larger scale. Each interface in one chain is matched with an interface in the second chain with which it has the highest PSS. Interfaces are ordered in this way, and the individual interaction matrices are then inscribed into the larger chain/chain or crystal/crystal interaction matrix. The Frobenius product of this matrix is then taken. However, since best-matches are not necessarily reciprocal, the best-interface-matching process is repeated in reverse to ensure reciprocity of the chain or crystal PSS. The Frobenius products of the two matrices are added and then normalized to give the chain or crystal PSS.

Each interface in a crystal structure is quantitatively described by a contact matrix C containing the corresponding $C_{ij}$ values (i.e., with its rows and columns indexed by the residue numbers in the two interaction proteins). To evaluate the similarity in inter-protein interfaces formed by homologous proteins, their sequences are aligned using CLUSTAL-W (Higgins et al., *Using CLUSTAL for multiple sequence alignments*. Methods in Enzymology 266, 383-402 (1996)) after transitively grouping together all proteins sharing at least 25% sequence identity. This procedure effectively aligns both the columns and rows in the contact matrices for interfaces formed by the homologous proteins. The Packing Similarity Score (PSS) between the interfaces is then calculated as the Frobenius (matrix-direct) product between the respective contact matrices. This procedure is mathematically equivalent to calculating a dot-product between vectors filled with the contact count between corresponding residue pairs in homologous interfaces. PSS values range from 1.0, if the number of contacts between each interfacial residue pair is identical, to 0.0, if no pair-wise contacts are preserved.

FIG. 5 shows statistics from application of the analytical scheme shown in FIG. 3 to all crystal structures in the PDB (39,208 entries). The average number of total, proper, and non-proper interfaces per protein molecular are 6.9, 1.8, and 5.1, respectively (FIG. 5A). While a minimum of four interfaces is required for a single molecule to form a 3-dimensional lattice, fewer are possible when multiple molecules are present in the crystallographic asymmetric unit. Proteins generally contain only a small number of interfaces beyond the minimum required for lattice formation, indicating that most interfaces contribute to structural stabilization of the lattice. On average, 50% of surface-exposed residues and 36% of all residues participate in inter-protein packing interactions (FIG. 5B). While interfaces range widely in size, 36% of all interfaces and 42% of non-proper interfaces contain 10 or fewer residues counting contributions from both sides of the interface (~5 from each participating molecule) (FIG. 5C). The small size of the average interface is encouraging relative to the feasibility of engineering interface formation. Half of all interfaces are under eight residues in size, and a quarter (8678 total in the dataset analyzed herein) are under eight residues in range within the polypeptide chain (separation). The cumulative size/range distributions for all interfaces, CBIEs, and EBIEs (FIG. 5D) shows that most interfaces are topologically simple and local in the primary sequence, even though some are complex. It is noteworthy that FBIEs contain on average fewer than two EBIEs and that most EBIEs are less than 4 residues in size and 10 residues in range. These small EBIEs represent prime candidates for engineering improved crystallization-resistant proteins.

The epitope library was used to count all EBIEs that appear in the PDB, and to determine which sequences are statistically over-represented in EBIEs given their background frequency in non-interacting sequences in the PDB. Before specific amino acid sequences were considered, the secondary structure patterns that appeared most frequently in EBIEs were examined. Some secondary structure patterns appeared much more frequently than others; these are summarized in Table 1.

TABLE 1

SECONDARY STRUCTURE MOTIFS IN EBIEs[a]

| Size | Secondary Structure | Fraction in PDB | Fraction in EBIEs | Probability in EBIE | Null Probability in EBIE | Z Score | P-value* |
|---|---|---|---|---|---|---|---|
| 1 | C | 0.41 | 0.510 | 0.357 | 0.33 | 85.2 | 0 |
| 1 | H | 0.36 | 0.332 | 0.321 | 0.33 | -33.8 | 3.21E-251 |
| 1 | E | 0.23 | 0.159 | 0.290 | 0.33 | -91.3 | 0 |
| 2 | CC | 0.32 | 0.481 | 0.171 | 0.15 | 101.5 | 0 |
| 2 | HC | 0.036 | 0.048 | 0.168 | 0.15 | 29.1 | 1.51E-186 |
| 2 | CH | 0.035 | 0.042 | 0.154 | 0.15 | 9.5 | 6.95E-22 |
| 2 | EC | 0.049 | 0.042 | 0.151 | 0.15 | 4.8 | 7.29E-07 |
| 2 | CE | 0.050 | 0.046 | 0.144 | 0.15 | -4.2 | 1.65E-05 |
| 2 | HE | 0.0016 | 0.00061 | 0.118 | 0.15 | -5.5 | 2.70E-08 |
| 2 | EH | 0.0029 | 0.0012 | 0.091 | 0.15 | -16.9 | 5.60E-64 |
| 2 | EE | 0.184 | 0.106 | 0.134 | 0.15 | -31.3 | 1.84E-215 |
| 2 | HH | 0.320 | 0.232 | 0.116 | 0.15 | -113.7 | 0 |
| 3 | HCC | 0.031 | 0.051 | 0.096 | 0.076 | 35.8 | 2.51E-280 |
| 3 | CCH | 0.029 | 0.042 | 0.094 | 0.076 | 30.4 | 1.10E-203 |
| 3 | CCC | 0.245 | 0.436 | 0.094 | 0.076 | 98.0 | 0 |
| 3 | CHH | 0.035 | 0.057 | 0.092 | 0.076 | 31.2 | 1.42E-214 |
| 3 | ECC | 0.043 | 0.052 | 0.090 | 0.076 | 27.2 | 1.33E-162 |
| 4 | HCCH | 0.0025 | 0.0040 | 0.057 | 0.042 | 9.4 | 4.30E-21 |
| 4 | HCHH | 0.0026 | 0.0044 | 0.057 | 0.042 | 9.6 | 4.55E-22 |

TABLE 1-continued

SECONDARY STRUCTURE MOTIFS IN EBIEs[a]

| Size | Secondary Structure | Fraction in PDB | Fraction in EBIEs | Probability in EBIE | Null Probability in EBIE | Z Score | P-value* |
|---|---|---|---|---|---|---|---|
| 4 | HCCC | 0.026 | 0.046 | 0.056 | 0.042 | 30.0 | 7.12E−198 |
| 4 | CCCH | 0.023 | 0.039 | 0.056 | 0.042 | 27.3 | 2.22E−164 |
| 4 | CECH | 0.00083 | 0.00077 | 0.055 | 0.042 | 3.7 | 0.000142 |

[a]Table 1 shows the secondary structure motifs (coil [C], strand [E], or helix [H]) most over-represented in EBIEs. Full distributions are shown for sequences of length 1 and 2, and the 5 most over-represented (and statistically significant) sequences of length 3 and 4. The table shows the frequency of that motif in the PDB generally, the frequency in EBIEs, the probability of any given instance of that motif participating in an EBIE, the null probability of any sequence of that length participating in an EBIE, and the Z-score and P-value of that over- or under-representation. All calculations were done on the weighted set of chains.
*P-values denoted 0 fell below the computational threshold of Microsoft Excel, and are therefore less than $10^{-300}$.

Next, amino acid sequences which appear as subsequences within EBIEs (e.g., an interacting trimer which makes up only part of an EBIE) were considered. Due to computational restrictions, the statistical analysis was only performed on dimers, trimers, and tetramers. Many of these short amino acid sequences are significantly over-represented in the set of EBIEs (Table 2).

TABLE 2

TOP SEQUENCE MOTIFS IN EBIEs, IGNORING SECONDARY STRUCTURE.[a] (SEQ ID NOS 12-26, respectively, in order of appearance)

| Size | Sequence | Fraction in PDB | Fraction in EBIEs | Probability in EBIE | Null Probability in EBIE | Z Score | P-value* |
|---|---|---|---|---|---|---|---|
| 2 | HH | 0.00109 | 0.00032 | 0.30 | 0.15 | 32.9 | 5.43E−238 |
| 2 | WC | 9.48E−05 | 2.26E−05 | 0.24 | 0.15 | 5.9 | 2.10E−09 |
| 2 | CH | 0.00037 | 8.04E−05 | 0.22 | 0.15 | 9.1 | 6.03E−20 |
| 2 | HM | 0.00051 | 0.00011 | 0.21 | 0.15 | 10.2 | 8.33E−25 |
| 2 | CS | 0.00070 | 0.00015 | 0.21 | 0.15 | 11.1 | 4.95E−29 |
| 3 | SCW | 5.35E−06 | 4.69E−06 | 0.88 | 0.076 | 16.6 | 1.01E−25 |
| 3 | HHH | 0.00033 | 0.00011 | 0.33 | 0.076 | 42.3 | 0 |
| 3 | WCG | 1.87E−05 | 6.26E−06 | 0.33 | 0.076 | 10.0 | 3.96E−23 |
| 3 | SHM | 8.78E−05 | 2.29E−05 | 0.26 | 0.076 | 15.6 | 2.13E−54 |
| 3 | VAC | 3.48E−05 | 8.11E−06 | 0.23 | 0.076 | 8.3 | 1.32E−16 |
| 4 | CSAG | 1.55E−05 | 6.55E−11 | 1.26 | 0.042 | 21.8 | 1.56E−29 |
| 4 | TQWC | 1.79E−06 | 7.58E−12 | 0.98 | 0.042 | 11.5 | 7.42E−09 |
| 4 | HCGV | 5.29E−06 | 2.23E−11 | 0.80 | 0.042 | 12.3 | 5.04E−10 |
| 4 | ACNG | 2.96E−06 | 1.25E−11 | 0.80 | 0.042 | 11.1 | 6.40E−09 |
| 4 | DACQ | 6.9E−06 | 2.92E−11 | 0.79 | 0.042 | 12.6 | 4.18E−11 |

[a]Table 2 shows the amino acid sequences most over-represented in EBIEs, ignoring secondary structure. The top five most over-represented (and statistically significant) examples are shown for sequences of length 2, 3, and 4. The table shows the frequency of that motif in the PDB generally (weighted by surface-interior proclivity to match the surface-interior distribution of EBIEs, as described above), the frequency in EBIEs, the probability of any given instance of that motif participating in an EBIE, the null probability of any sequence of that length participating in an EBIE, and the Z-score and P-value of that over- or under-representation. All calculations were done on the weighted set of chains.
*P-values denoted 0 fell below the computational threshold of Microsoft Excel, and are therefore less than $10^{-300}$.

Finally, it was determined which complete EBIE sequences appeared significantly more frequently than their background frequency would suggest (Table 3).

TABLE 3

TOP SEQUENCE MOTIFS IN EBIEs, INCLUDING SECONDARY STRUCTURE.[a] (SEQ ID NOS 27-41, respectively, in order of appearance)

| Size | Sequence | Secondary Structure | Fraction in PDB | Fraction in EBIEs | Probability in EBIE | Null Probability in EBIE | Z Score | P-value* |
|---|---|---|---|---|---|---|---|---|
| 2 | CW | H | 2.2E−05 | 1.01E−05 | 0.46 | 0.15 | 9.8 | 1.59E−22 |
| 2 | HH | CC | 0.00060 | 0.00023 | 0.38 | 0.15 | 39.0 | 0 |
| 2 | WC | CC | 3.75E−05 | 1.37E−05 | 0.37 | 0.15 | 9.0 | 3.82E−19 |

TABLE 3-continued

TOP SEQUENCE MOTIFS IN EBIEs,
INCLUDING SECONDARY STRUCTURE.[a] (SEQ ID NOS 27-41,
respectively, in order of appearance)

| Size | Sequence | Secondary Structure | Fraction in PDB | Fraction in EBIEs | Probability in EBIE | Null Probability in EBIE | Z Score | P-value* |
|---|---|---|---|---|---|---|---|---|
| 2 | HM | CC | 0.00022 | 7.21E−05 | 0.32 | 0.15 | 17.5 | 2.31E−68 |
| 2 | GK | CH | 0.00029 | 8.05E−05 | 0.28 | 0.15 | 14.8 | 2.31E−49 |
| 3 | PTW | CEE | 2.17E−06 | 2.35E−06 | 1.08 | 0.076 | 12.2 | 5.03E−14 |
| 3 | CAT | ECC | 1.94E−06 | 1.96E−06 | 1.01 | 0.076 | 11.5 | 5.15E−12 |
| 3 | VAC | ECC | 7.11E−06 | 7.16E−06 | 1.01 | 0.076 | 22.1 | 5.11E−44 |
| 3 | GSC | CCH | 3.19E−06 | 2.96E−06 | 0.93 | 0.076 | 13.6 | 5.11E−17 |
| 3 | VGK | CCH | 1.56E−05 | 1.33E−05 | 0.85 | 0.076 | 27.5 | 4.72E−164 |
| 4 | AGKT | CCHH | 1.43E−05 | 6.04E−11 | 2.12 | 0.042 | 19.6 | 5.89E−24 |
| 4 | VGKS | CCHH | 2.49E−05 | 1.05E−10 | 1.39 | 0.042 | 27.5 | 1.88E−45 |
| 4 | GNLA | CCCE | 1.97E−06 | 8.33E−12 | 1.33 | 0.042 | 13.0 | 3.81E−10 |
| 4 | QGLG | CCHH | 1.2E−06 | 5.08E−12 | 1.33 | 0.042 | 11.6 | 5.84E−09 |
| 4 | AAGK | CCCH | 5.92E−06 | 2.5E−11 | 1.31 | 0.042 | 16.9 | 6.53E−17 |

[a]Table 3 shows the amino acid sequences most over-represented in EBIEs, considering secondary structure. The top five most over-represented (and statistically significant) examples are shown for sequences of length 2, 3, and 4, where the sequence is considered to be the combination of residue identity and secondary structure (coil [C], strand [E], or helix [H]) for that position, as calculated by DSSP. The table shows the frequency of that motif in the PDB generally (weighted by surface-interior proclivity to match the surface-interior distribution of EBIEs, as described above), the frequency in EBIEs, the probability of any given instance of that motif participating in an EBIE, the null probability of any sequence of that length participating in an EBIE, and the Z-score and P-value of that over- or under-representation. All calculations were done on the weighted set of chains.
*P-values denoted 0 fell below the computational threshold of Microsoft Excel, and are therefore less than $10^{-300}$.

As of the time of the analysis presented herein, among the PDB protein chains there were 54,317,358 potential epitope subsequences of length 1 to 6. The substrings describe primary and secondary structure and are of forms like FxGH (SEQ ID NO: 539) CcCH, i.e., intermediate amino acid letters masked by x's are ignored but their secondary structure is still considered. There are 31 such masks total. Not every possible permutation of 20 amino acids and 3 structure codes among the 31 masks (57,625,347,600 total) is found in the PDB. Accordingly, 54,317,358 is the number of independent trials for purposes of Bonferroni correction for multiple-hypothesis testing. Therefore, the 5% significance threshold becomes 9.205e-10 after dividing by the number of independent tests.

In some embodiments, all epitope subsequences that make up the final library have an over-representation-in-interfaces P-value below the afore mentioned significance threshold. In some embodiments, the sequence's redundancy-weighted "in epitopes" and "in prior" counts are at least 10 (in order to deprioritize the few epitopes with very low counts that still manage to remain significant). In some embodiments, the fraction of redundancy-corrected occurrences of the epitope having non-water bridging solvent molecules is no more than 50% of the total such count, and the sequence's over-representation ratio (redundancy-corrected count in epitopes/expected redundancy-corrected count in epitopes) is at least 1.5. The number of epitopes that meet these four criteria is 2,040. They make up one embodiment of an epitope subsequence library for use in crystallization engineering.

Tables 4-35 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance) (in Appendix A) provide a list of 100 top patterns (engineering candidates) for epitopes in each of 32 interaction pattern classes. Column "Sequence" provides the amino acid sequence of the epitope subsequence (Tables 5-35 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance)) or of a single amino acid (Table 4). Lower case 'x' means that that the amino acid identity of the residue at that position has not been explicitly considered. Column "Structure" shows the observed secondary structure motifs (loop or coil [C], beta strand [E], or helix [H]) of the pattern. All measured frequencies of occurrence were redundancy-corrected. Column "In Epitopes" represents the observed number of occurrences of each epitope in the PDB. Column "Expected in Epi" represents the expected number of each epitope in crystal-packing interfaces in the PDB. Column "In PDB" represents the total number of times the epitope's sequence appears in the PDB, regardless of whether or not it participates in interactions. Column "Z-score" represents the number of standard deviations that the observed count is away from the expected count. P-values represent the upper and the lower tail integrals of the binomial distribution. Column "Distribution" represents whether the distribution is approximated as normal (N) or as exact binomial (B). The "Observed ratio" is the fraction of "In PDB" that actually makes crystal-packing contacts. "Null probability" is the fraction of "In PDB" expected in crystal-packing epitopes. All calculations were done on the weighted set of chains. *—P-values denoted 0 fell below the lowest floating point precision value, and are therefore at least less than $10^{-300}$.

Table 36 (in Appendix A) provides a list of epitopes subsequences according to some embodiments of the invention. In Table 36, "Num Crystal Sets" is the number of crystals in the PDB containing the epitope subsequence after correction for redundancy in overall packing using PSS. "Num Interface Intersets" is the number of interfaces in the PDB containing the epitope subsequence after correction for redundancy in overall packing using PSS. "Num Chainsets 25" is the number of sequence-unique proteins (<25% identity between any pair) in the PDB containing the epitope subsequence. "Non-Water Solvent" is the fraction of epitopes containing the epitope subsequence whose contacts to the partner epitope across the crystal-packing interface involve bridging interactions via ligands bound to the protein or via small molecules from the crystallization solution other than water. The details for Table 37 is provided further below.

Surprisingly, many epitopes in Tables 2-3 and 5-37 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance) include polar residues. Epitopes with polar residues are advantageous as they are less likely to cause the modified protein to become insoluble.

In some embodiments, the epitope library comprises the epitopes in Tables 5-37 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance). In some embodiments, the epitope library comprises at least 100, at least 200, or at least 300 epitopes from the list of epitopes in Tables 2-3 and 5-37 (Table 5, in its entirety, discloses SEQ ID NOS 118-216, respectively, in order of appearance; Table 6, in its entirety, discloses SEQ ID NOS 217-315, respectively, in order of appearance; Table 7, in its entirety, discloses SEQ ID NOS 316-414, respectively, in order of appearance; Table 8, in its entirety, discloses SEQ ID NOS 415-513, respectively, in order of appearance; Table 9, in its entirety, discloses SEQ ID NOS 514-612, respectively, in order of appearance; Table 10, in its entirety, discloses SEQ ID NOS 613-711, respectively, in order of appearance; Table 11, in its entirety, discloses SEQ ID NOS 712-810, respectively, in order of appearance; Table 12, in its entirety, discloses SEQ ID NOS 811-909, respectively, in order of appearance; Table 13, in its entirety, discloses SEQ ID NOS 910-1,008, respectively, in order of appearance; Table 14, in its entirety, discloses SEQ ID NOS 1,009-1,107, respectively, in order of appearance; Table 15, in its entirety, discloses SEQ ID NOS 1,108-1,206, respectively, in order of appearance; Table 16, in its entirety, discloses SEQ ID NOS 1,207-1,305, respectively, in order of appearance; Table 17, in its entirety, discloses SEQ ID NOS 1,306-1,404, respectively, in order of appearance; Table 18, in its entirety, discloses SEQ ID NOS 1,405-1,503, respectively, in order of appearance; Table 19, in its entirety, discloses SEQ ID NOS 1,504-1,602, respectively, in order of appearance; Table 20, in its entirety, discloses SEQ ID NOS 1,603-1,701, respectively, in order of appearance; Table 21, in its entirety, discloses SEQ ID NOS 1,702-1,800, respectively, in order of appearance; Table 22, in its entirety, discloses SEQ ID NOS 1,801-1,899, respectively, in order of appearance; Table 23, in its entirety, discloses SEQ ID NOS 1,900-1,998, respectively, in order of appearance; Table 24, in its entirety, discloses SEQ ID NOS 1,999-2,097, respectively, in order of appearance; Table 25, in its entirety, discloses SEQ ID NOS 2,098-2,196, respectively, in order of appearance; Table 26, in its entirety, discloses SEQ ID NOS 2,197-2,295, respectively, in order of appearance; Table 27, in its entirety, discloses SEQ ID NOS 2,296-2,394, respectively, in order of appearance; Table 28, in its entirety, discloses SEQ ID NOS 2,395-2,493, respectively, in order of appearance; Table 29, in its entirety, discloses SEQ ID NOS 2,494-2,592, respectively, in order of appearance; Table 30, in its entirety, discloses SEQ ID NOS 2,593-2,691, respectively, in order of appearance; Table 31, in its entirety, discloses SEQ ID NOS 2,692-2,790, respectively, in order of appearance; Table 32, in its entirety, discloses SEQ ID NOS 2,791-2,889, respectively, in order of appearance; Table 33, in its entirety, discloses SEQ ID NOS 2,890-2,988, respectively, in order of appearance; Table 34, in its entirety, discloses SEQ ID NOS 2,989-3,087, respectively, in order of appearance; Table 35, in its entirety, discloses SEQ ID NOS 3,088-3,186, respectively, in order of appearance).

Computational Methods for Modifying Protein Sequences to Improve their Crystallization Methods for modifying protein amino acid sequences to improve crystallization properties of the protein can be implemented on a server (in some instances referred to herein as the "protein engineering" server). In some embodiments, the server accepts a target protein sequence from a user and outputs one or more (in some embodiments several) protein sequences related to the target sequence, but having amino acid mutations that will improve crystallization of the target sequences. In general, the predicted secondary and tertiary structure of the target protein sequence is preserved in the modified protein.

Figure 6:
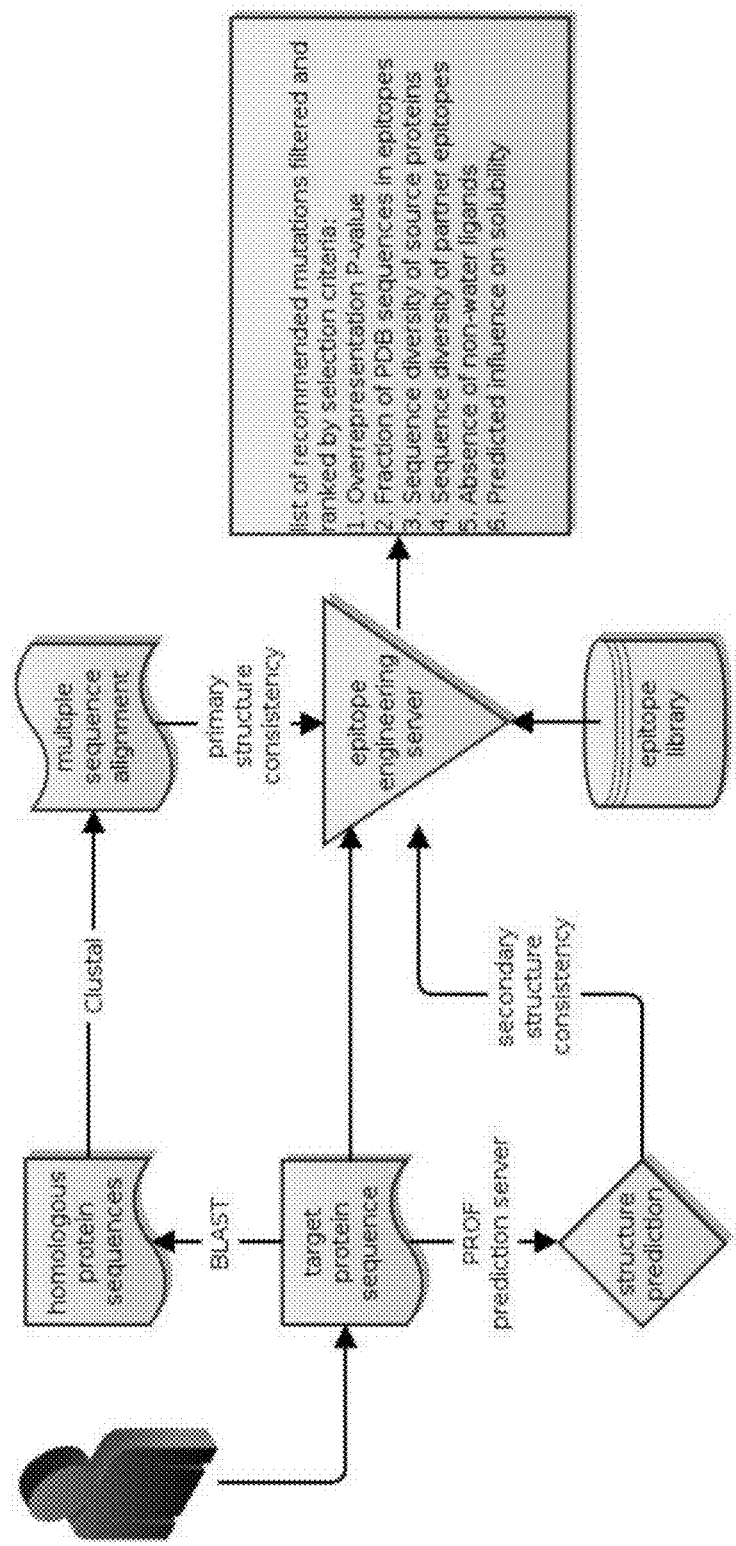
FIG. 6 shows a schematic overview of statistical methods and epitope-engineering software.

One such embodiment of the method is described with reference to a protein engineering server described with reference to FIG. 6. In this embodiment, a user provides the amino acid sequence of the target protein to the server (the server receives the target protein sequence from the user). The server finds homologous protein sequences, for example using a program such as BLASTp, available through the National Center for Biotechnology Information (www.ncbi.nlm.nih.gov), and are described in, for example, Altschul et al. (1990), *J. Mol. Biol.* 215:403-410; Gish and States (1993), *Nature Genet.* 3:266-272; Madden et al. (1996), *Meth. Enzymol.* 266:131-141; Altschul et al. (1997), *Nucleic Acids Res.* 25:33 89-3402); Zhang et al. (2000), *J. Comput. Biol.* 7(1-2):203-14.

The server then performs a multiple sequence alignment of the target sequence with the homologous protein sequences for example using a program such as CLUSTAL (Chema et al., *Multiple sequence alignment with the Clustal series of programs. Nucleic Acids Res* 31(13):3497-500 (2003)). The server can also predict the structure of the target protein sequences, for example using a program such as PHD/PROF (Rost, B., *PHD: predicting one-dimensional protein structure by profile-based neural networks. Methods in Enzymology* 266, 525-539 (1996)). The epitope engineering part of the server takes one or more inputs selected from any combination of the target protein sequence, multiple sequence alignments, predicted secondary structure and the epitope subsequence library and provides a list of recommended mutations to improve protein crystallization. The output from the server can either be in the form of a list of mutations to be made in the target sequence or in the form of one or more amino acid sequences of the modified protein.

In some embodiments, multiple epitope subsequences are introduced in the amino acid sequence of the target protein simultaneously to provide a modified protein. For example, 1, 2, 3, 4, 5, or more epitope subsequences can be introduced into the same target protein to generate a modified protein.

In some embodiments, the engineering part of the server uses one or more of the following epitope prioritization criteria: over-representation P-value of the epitope subsequence in packing interfaces; fraction of occurrences of that epitope subsequence that make crystal-packing contacts in the PDB (i.e., that reside within EBIEs); frequency of occurrence of that epitope subsequence in the PDB database; sequence diversity of proteins containing that epitope subsequence in the PDB; sequence diversity of partner epitopes interacting with the corresponding epitope across crystal-packing interfaces in the PDB; absence of non-water bridging ligands in the crystal-packing interactions made by the corresponding epitopes in the PDB; lack of increase in hydrophobicity of the modified protein by introducing the epitope subsequence; or predicted influence of the epitope subsequence on the solubility of the modified protein. Each of the prioritization criteria can be assigned a different weight, including no weight. Any combination of these prioritization criteria can be used.

In some embodiments, an epitope subsequence that is over-represented by P-value of the epitope subsequence in the epitope subsequence library is a particularly suitable epitope subsequence for improving protein crystallization.

Fraction of epitope subsequence in crystal-packing contacts is the redundancy-corrected number of an epitope subsequence in crystal-packing contacts in the PDB divided by the redundancy-corrected total number of the epitope subsequence in the PDB. In some embodiments, an epitope subsequence for which a a high fraction of its occurences in the PDB occur in crystal-packing contacts is a particularly suitable epitope for improving protein crystallization.

In some embodiments, an epitope with a high frequency of occurrence in the PDB is a particularly suitable epitope subsequence for improving protein crystallization. In some embodiments, an epitope subsequence that is present in proteins of diverse sequence in the PDB is a particularly suitable epitope subsequence for improving protein crystallization.

Partner epitopes are other epitopes contacted by an epitope in the PDB. In some embodiments, an epitope subsequence whose corresponding epitopes contact a diverse set of different epitopes in the PDB is a particularly suitable epitope for improving protein crystallization.

Non-water bridging ligands are non-protein molecules such as nucleotides and buffer salts. In some embodiments, an epitope subsequence whose corresponding epitopes frequently make contacts to partner epitopes via a non-water bridging ligand in the PDB is not a particularly suitable epitope subsequence for improving protein crystallization.

In some embodiments, an epitope subsequence that does not increase the hydrophobicity of the modified protein is a particularly suitable epitope subsequence for improving protein crystallization.

In some embodiments, an epitope subsequence that does not reduce the solubility of the modified protein is a particularly suitable epitope subsequence for improving protein crystallization. Solubility of a protein can be predicted, for example, using a computational predictor of protein expression/solubility (PES) was produced (available online at http://nmr.cabm.rutgers edu:8080/PES/) (Price et al., 2011, Microbial Informatics and Experimentation, 1:6, doi: 10.1186/2042-5783-1-6). Solubility can also be predicted as described in PCT/US11/24251, filed Feb. 9, 2011.

In some embodiments, the prioritized selection criterion is over-representation ratio, using a P-value cutoff. In some embodiments, the selection criteria are selected to prioritize mutations improving over-representation ratio at a given site (i.e., avoiding removing an epitope subsequence with a better ratio than the new epitope subsequence). In some embodiments, the selection criteria are selected to prioritize epitopes subsequence observed in packing interactions in at least 50 sequence-unrelated proteins ("chainsets") in the PDB. In some embodiments, the selection criteria are selected to favor substitutions maintaining or increasing polarity over those reducing polarity.

The list of epitopes subsequence in the epitope subsequence library can be obtained from the comprehensive hierarchical analysis of the entirety of the PDB (several million epitopes total, the counts for each being redundancy-corrected), obtained for example as described below, which is then culled by the over-representation significance P-value against the Bonferroni-corrected 95% significance threshold. Epitopes subsequence can be discarded if they primarily participate only in solvent molecule-mediated bridging interactions involving molecules other than water, such as epitopes in nucleotide-binding motifs. Epitope subsequences can also be discarded if the total number of distinct protein homology sets that the corresponding epitopes appears in is too low, to ensure that the epitope's source structures have some variety.

In some embodiments, the resulting epitope subsequence library contains 1000-3000 epitopes. In some embodiments, the epitope subsequence library contains about 1000, about 2000, or about 3000 epitopes. In a specific embodiment, the epitope subsequence library contains about two-thousand epitopes.

In some embodiments, the epitope subsequences are 1-6 residues in size. In other embodiments, the epitope subsequences are 2-15 residues in size. Each epitope also has a secondary structure mask associated with it, for example, HHH, CCCC, HCCCH, ECCE, where H=helix, C=coli and E=beta strand.

In some embodiments, to generate mutation suggestions to improve crystallization for a protein of unknown structure, the method combines the epitope subsequence library, a secondary structure prediction by PHD/PROF, and a multiple sequence alignment of proteins homologous to the target. At every position in the target protein sequence, the method examines whether any one of the epitope subsequences from the epitope library can be introduced there through a change of a few amino acids. In some embodiments, a mutation at any one position is only allowed if the new amino acid can also be found at the same aligned position in one of the other homologous proteins. In some embodiments, "correlated evolution" metrics (Liu et al., *Analysis of correlated mutations in HIV-1 protease using spectral clustering*. Bioinformatics 2008, 24 (10), 1243-50; Eyal et al., *Rapid assessment of correlated amino acids from pair-to-pair (P2P) substitution matrices*. Bioinformatics 2007, 23 (14), 1837-9; Hakes et al., *Specificity in protein interactions and its relationship with sequence diversity and coevolution*. Proceedings of the National Academy of Sciences of the United States of America 2007, 104 (19), 7999-8004; Kann et al., Correlated evolution of interacting proteins: looking behind the mirrortree. *J Mol Biol* 2009, 385 (1), 91-8; Kann et al., *Predicting protein domain interactions from coevolution of conserved regions*. Proteins 2007, 67 (4), 811-20) can be used to deprioritize mutations anti-correlated with residue identity at other positions in the protein sequence to be mutated, which may be predictive of reduced stability of modified proteins.

In some embodiments, the secondary structure of the epitope subsequence to be inserted matches the predicted secondary structure (within some tolerated deviation). These criteria increase the probability that the mutations do not destabilize the target protein by introducing biophysically incongruent changes.

In some embodiments, there are approximately 100-300 epitope subsequences from the library that can be introduced at some position within the sequence in agreement with these guidelines.

In some embodiments, the epitope subsequences that are expected to improve crystallization of the target protein are sorted by their over-representation ratio in the PDB and presented to the researcher. The researcher can choose which and how many mutations to make, preferentially starting from the top of the list, depending on the available resources and specific peculiarities of the target protein.

Protein Engineering Server

The techniques, methods and systems disclosed herein may be implemented as a computer program product for use with a computer system or computerized electronic device. Such implementations may include a series of computer instructions, or logic, fixed either on a tangible medium, such as a computer readable medium (e.g., a diskette, CD-ROM, ROM, flash memory or other memory or fixed disk) or transmittable to a computer system or a device, via a modem or other interface device, such as a communications adapter connected to a network over a medium.

The medium may be either a tangible medium (e.g., optical or analog communications lines) or a medium implemented with wireless techniques (e.g., Wi-Fi, cellular, microwave, infrared or other transmission techniques). The series of computer instructions embodies at least part of the functionality described herein with respect to the system. Those skilled in the art should appreciate that such computer instructions can be written in a number of programming languages for use with many computer architectures or operating systems.

Furthermore, such instructions may be stored in any tangible memory device, such as semiconductor, magnetic, optical or other memory devices, and may be transmitted using any communications technology, such as optical, infrared, microwave, or other transmission technologies.

It is expected that such a computer program product may be distributed as a removable medium with accompanying printed or electronic documentation (e.g., shrink wrapped software), preloaded with a computer system (e.g., on system ROM or fixed disk), or distributed from a server or electronic bulletin board over the network (e.g., the Internet or World Wide Web). Of course, some embodiments of the invention may be implemented as a combination of both software (e.g., a computer program product) and hardware. Still other embodiments of the invention are implemented as entirely hardware, or entirely software (e.g., a computer program product).

Efficient Mutational Engineering of Protein Crystallization

The invention provides a new approach to engineering improved protein crystallization based on introduction of historically successful crystallization epitopes into crystallization-resistant proteins. Datamining the results of high-throughput experimental studies indicated that crystallization propensity is controlled primarily by the prevalence of low-entropy surface epitopes capable of mediating high-quality crystal-packing interactions (Price et al., *Understanding the physical properties that control protein crystallization by analysis of large-scale experimental data*. Nat Biotechnol 27 (1), 51-7 (2009)). The PDB contains a massive archive of such epitopes in deposited crystal structures.

In one embodiment, the invention provides methods for mutational engineering of crystallization that are efficient enough to enable the structure of any target protein to be determined with relatively modest effort compared to pre-existing methods.

The thermodynamics of crystallization have been analyzed extensively. If the individual packing interfaces in the lattice have favorable free energy, formation of a regular lattice is thermodynamically favored because of the consistent gain in energy for every added molecule. The prevalence of surface epitopes with high propensity to form such favorable interactions is likely to determine whether a particular protein can find a regular lattice structure with favorable intermolecular interactions or whether it precipitates amorphously with heterogeneous packing interactions. Increasing the prevalence of surface epitopes with favorable packing potential, as evidenced by participation in many interfaces in the PDB, can increase the probability of high quality crystallization.

Surface Entropy is a Determinant of Protein Crystallization Propensity

Results of large-scale experimental studies were analyzed to develop insight into the physical properties controlling protein crystallization. Statistical analyses were used to evaluate the relationship between protein sequence and successful crystal-structure determination (Price et al., *Understanding the physical properties that control protein* crystallization by analysis of large-scale experimental data. *Nat Biotechnol* 27 (1), 51-7 (2009)). The dataset comprised 679 biochemically well-behaved proteins that were taken through a consistent expression, purification, quality-control, and crystallization pipeline to yield 157 structures. Proteins yielding crystals of insufficient quality for structure determination were considered failures even if diffraction was observed, as occurred for 39 proteins. Retrospective analyses demonstrated that some key sequence features of these are more similar to proteins that failed to yield structures than those that did. Sequence properties that were analyzed included the frequency of each amino acid, mean hydrophobicity, mean side-chain entropy, a variety of electrostatic parameters, and the fraction of residues predicted to be disordered by the program DISOPRED2 (Ward et al., *The DISOPRED server for the prediction of protein disorder. Bioinformatics* 20 (13), 2138-9 (2004)). Logistic regressions were performed to evaluate the relationship between each of these continuous sequence parameters and the binary outcome of the crystallization/structure-determination effort. These analyses demonstrated that many sequence parameters are significantly predictive of outcome. However, multiple logistic regression and other analyses showed that most sequence effects are surrogates for side-chain entropy. Statistically independent contributions are made only by the predicted fraction of disordered residues (an inhibitory factor) and the fractional content of Ala, Gly, and possibly Phe residues (all positively correlated with success). Furthermore, we demonstrated that the side-chain entropy effect is localized to residues predicted to be surface exposed according to the PHD-PROF program (Rost, B., *PHD: predicting one-dimensional protein structure by profile-based neural networks. Methods in Enzymology* 266, 525-539 (1996)), which predicts both secondary structure and surface localization with ~80% accuracy.

These analyses establish surface entropy as a major determinant of protein crystallization propensity. They also indicated that the Gly residues promoting successful crystallization are localized to short surface loops and likely to be at least partially buried in inter-protein packing interfaces.

Thermodynamic Stability is not a Major Determinant of Protein Crystallization Propensity In the studies described herein, thermodynamic stabilities of a substantial subset of proteins in the crystallization dataset were measured. These studies showed a small advantage for hyper-stable proteins but equivalent crystallization propensity for proteins spanning the wide range of stability characteristic of the most proteins from mesophilic organisms. Therefore, thermodynamic stability is not a major determinant of protein crystallization. In aggregate, large-scale experimental studies support the premise that protein surface properties, especially the prevalence of well-ordered epitopes capable of mediating inter-protein packing interactions, are paramount in determining crystallization propensity. This basis provided the impetus to systematically characterize such epitopes in the existing PDB with the goal of developing methods to use historically successful epitopes for rational engineering of improved protein crystallization.

Hydrodynamic Heterogeneity and Aggregation Impede Crystallization

The final crystallization stock of every protein in the experimental dataset was characterized using gel-filtration/static-light-scattering analyses. Consistent with previous theoretical and protein-engineering studies, stable oligomers crystallize significantly better than monomers. However, hydrodynamic heterogeneity impedes crystallization and aggregation strongly inhibits it. Although formation of specific oligomers strongly promotes crystallization, heterogeneous self-association inhibits it. Successful crystallization thus requires minimal non-specific self-association in dilute aqueous buffers but strong self-association under the low water-activity conditions used to form protein crystals. Accordingly, proteins with crystal structures deposited in the PDB should be enriched for surface epitopes with this special combination of physical properties.

Figure 7:
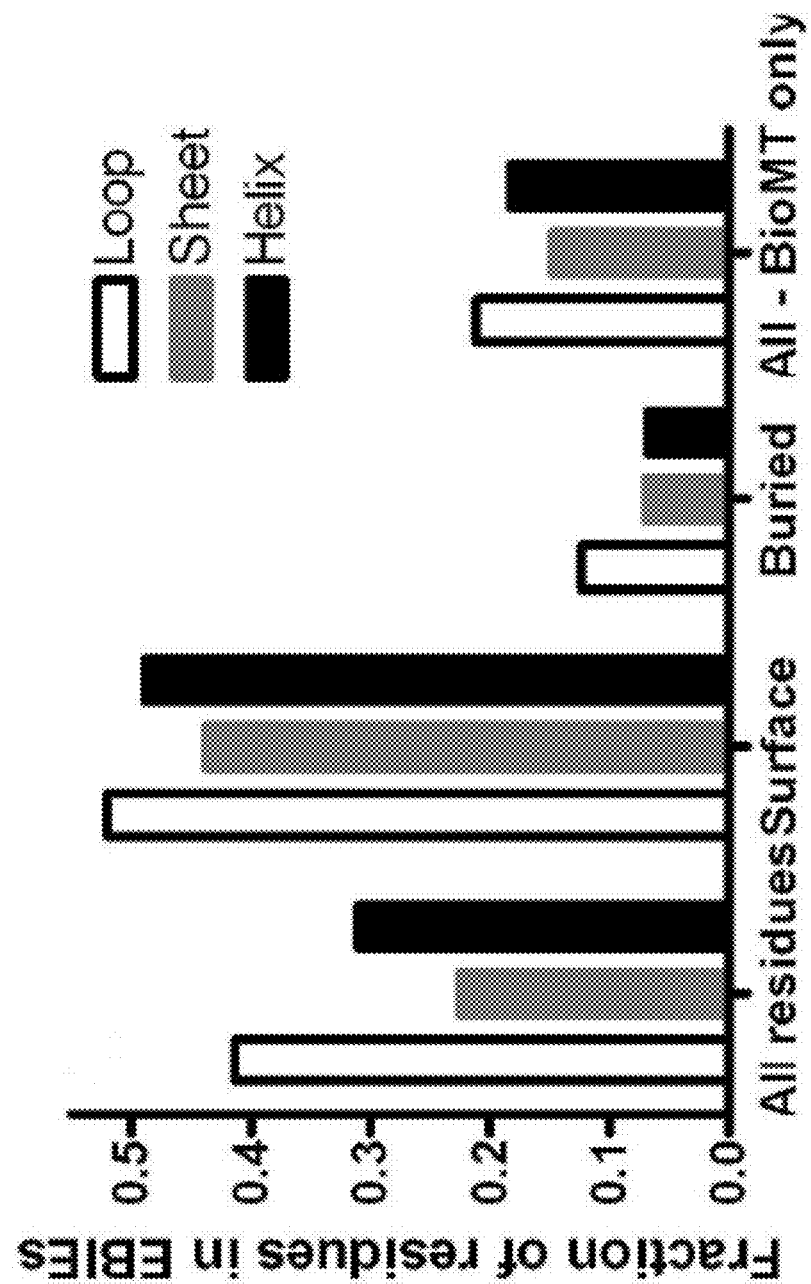
FIG. 7 shows a bar graph of the fraction of residues in loops, sheets, and alpha helices that interact in EBIEs. Fractions are shown for all residues, only residues that are surface-exposed or buried, as calculated by DSSP, or all residues interacting in BioMT interfaces only.

Single Amino-Acid Properties that Promote Crystallization Reduce Protein Solubility In a follow-up study, equivalent datamining methods were used to analyze correlations between sequence properties and in vivo expression/solubility results (Price et al., 2011, *Microbial Informatics and Experimentation*, 1:6, doi: 10.1186/2042-5783-1-6). This study examined 7733 proteins expressed and purified consistently using a T7 vector in codon-enhanced *E. coli* BL21λ(DE3) cells (PCT/US11/24251, filed Feb. 9, 2011). The relationship between primary sequence properties and the probability of obtaining a protein preparation useful for structural studies were analyzed. A computational predictor of protein expression/solubility ($P_{ES}$) was produced (available online at http://nmr.cabm.rutgers.edu:8080/PES/). With the exception of predicted backbone disorder, which inhibits both crystallization and solubility, every sequence property that promotes crystallization reduces solubility and vice-versa. These results demonstrate that single-residue mutations designed to enhance crystallization will tend to reduce the probability of obtaining a soluble protein preparation suitable for crystallization screening (FIG. 7).

Moreover, published results showed that hydrodynamic heterogeneity and aggregation, which are correlated with low solubility, significantly impede crystallization (Price et al., *Understanding the physical properties that control protein crystallization by analysis of large-scale experimental data. Nat Biotechnol* 27 (1), 51-7 (2009); Ferre-D'Amare and Burley, *Use of dynamic light scattering to assess crystallizability of macromolecules and macromolecular assemblies. Structure,* 2 (5), 357-9 (1994)). Therefore, any strategy focused on single-residue substitutions will suffer from problems with protein solubility, as observed for the Surface Entropy Reduction method.

Observations on the statistical influence of individual amino acids suggest that more complex sequence epitopes are needed to provide the simultaneous combination of good solubility and low surface entropy characteristic of proteins yielding crystal structures. These observations support the strategy of mining such epitopes out of existing crystal structures in the PDB.

Identification and Analysis of Epitopes Mediating Inter-Protein Packing Interactions in the PDB A hierarchical analytical scheme was developed to identify contiguous epitopes potentially useful for protein engineering and was used to analyze all inter-protein crystal-packing interactions in the PDB (FIG. 3). Bold lines represent protein chains, grey lines inter-atomic contacts ≤4 Å, and numbered circles show representative elements.

FIG. 5 shows selected statistics from application of our analytical scheme to all crystal structures in the PDB that do not have excessively close inter-protein contacts (39,208 entries). FIG. 5A shows histograms showing distributions of the fraction of residues participating in inter-protein packing contacts. FIG. 5B shows histograms showing number of interfaces per crystal. FIG. 5C is a cumulative distribution graph showing fraction of interfaces equal to or smaller in size than the number indicated on the abscissa. In this graph, residues from the two interacting molecules are counted separately. The curve labeled "Largest" shows data for the single largest non-proper interface in each crystal. FIG. 5D shows cumulative size and range distributions for hierarchically defined packing elements (counting residues from one of the interacting molecules).

The average numbers of total, proper, and non-proper interfaces per protein molecule are 6.9, 1.8 and 5.1, respectively (FIG. 5A). While at least four interfaces are required for a molecule to form a 3-dimensional lattice, fewer are possible if multiple molecules are present in the asymmetric unit. Proteins generally contain only a small number of interfaces above the minimum required for lattice formation, indicating that most interfaces contribute to structural stabilization of the lattice. On average, 50% of surface-exposed residues and 36% of all residues participate in inter-protein packing interactions (FIG. 5B). While interfaces range widely in size, 36% of all interfaces and 42% of non-proper interfaces contain 10 or fewer residues, counting contributions from both sides of the interface (~5 from each participating molecule) (FIG. 5C). The small size of the average interface is encouraging relative to the feasibility of engineering interface formation. FIG. 5D shows the cumulative size/range distributions for all EBIEs, CBIEs, and half-interfaces (i.e., participating residues from one of the two interacting molecules). These data show that, even though some interfaces are complex, most are topologically simple and local in primary sequence. Half of all half-interfaces are under eight residues in size, and a quarter (8678 total) are under eight residues in range (separation) in the polypeptide chain. FBIEs contain on average fewer than two EBIEs (not shown), and most EBIEs are less than 4 residues in size and 10 in range. These small EBIEs represent prime candidates for engineering improved crystallization.

Quantifying Similarity in the Crystal-Packing Interactions of Homologous Proteins Demonstrates Pervasive Polymorphism in Inter-Protein Interfaces A general method has been developed to quantify the similarity between different inter-protein packing interfaces formed by homologous proteins. Its foundation is a B-factor-weighted count ($C_{ij}$) of inter-atomic contacts between residues i and j across the interface:

$$C_{ij} = \sum_{atom.pairs} \left( \frac{\langle B \rangle_{2\text{-}10\%}}{\sqrt{B_m B_n}} \right)^n$$

The terms $B_m$ and $B_n$ are the atomic B-factors of the contacting atoms in residues i and j, respectively (i.e., atoms with centers separated by less than 4 Å), while $\langle B \rangle_{2\text{-}10\%}$ represents an estimate of the B-factor of the most ordered atoms in the structure (which is calculated as the average B-factor of atoms in the $2^{nd}$ through $10^{th}$ percentiles). An upper limit of 1.0 is imposed on the B-factor ratio (i.e., it is set to 1.0 whenever $(B_m B_n)^{1/2} << \langle B \rangle_{2\text{-}10\%}$). The exponent n is an adjustable parameter in our software that allows analyses to be performed either without (n=0) or with (n≥1) down-weighting of contacts between atoms with high B-factors. Such atoms, which have enhanced disorder, may contribute less to interface stabilization, but prior literature on this topic is lacking. Therefore, an analytical approach has been developed facilitating exploration of B-factor effects. Specifically, using higher values of n in our scoring function progressively down-weights high B-factor contacts.

Identification of Statistically Over-Represented Epitope Subsequences in Crystal-Packing Interfaces in the PDB Leads to Novel Ideas for Engineering Improved Protein Crystallization To identify promising motifs for use in enhancing crystallization propensity, statistical analyses of sequence patterns occurring in protein segments with specific secondary structures were conducted, as analyzed using the DSSP algorithm (Kabsch and Sander, *Dictionary of protein secondary structure: pattern recognition of hydrogen-bonded and geometrical features. Biopolymers* 22 (12), 2577-637 (1983)), which makes three-state assignments of α-helix (H), β-strand (E), or loop or coil (C).

The primary reason for using a simultaneous sequence/secondary-structure definition of a packing epitope is to facilitate application of these data to epitope-engineering. A given amino acid sequence will generally have different conformations at different sites in a protein. However, local conformation is likely to be similar when the sequence occurs in the same secondary structure (i.e., on the surface of a β-strand or in an α-helix capping motif). An epitope-visualization tool, implemented as part of our epitope-engineering web-server described below, enables users to verify this assumption for specific epitopes and provides support for its general validity.

Previously, sophisticated primary-sequence-analysis algorithms have been developed to predict local protein secondary structure as well as surface-exposure even in the absence of the 3-dimensional structure of the protein. PHD-PROF is one such program that was trained using DSSP, the software used to classify all crystal-packing epitopes in the PDB. Productive use was made of PHD-PROF in our published crystallization-datamining studies described above. PHD-PROF has been cross-validated and achieves ~80% accuracy in identifying residue secondary structure and surface-exposure status based on primary sequence alone. These results support the likely efficacy of using PHD-PROF to predict local secondary structure to guide introduction of historically successful crystallization epitopes at productive sites in proteins with unknown tertiary structure.

The initial approach to prioritizing the most promising crystallization epitope subsequences for engineering applications involves ranking their degree of over-representation in packing contacts in non-BioMT interfaces in the PDB (FIG. 1). Accurate assessment of over-representation requires careful correction for redundancy in previous observations of crystal-packing as well as normalization for the biased distribution of amino acids found on protein surfaces. PSS, described above, is used to quantitatively correct epitope subsequence counts for redundancies between the different packing interfaces in which they are found. The marginal count for each occurrence of a sub-epitope in an interface in a crystal is inversely proportional to the total number of crystals mostly identical to the given crystal, and to the number of interfaces within the crystal mostly identical to the given interface. Epitope subsequences in bio-oligomer (BIOMT) interfaces do not contribute to the count. This approach substantially boosts signal strength by counting the multiple contacts formed by an efficacious epitope subsequence found in crystal structures of homologous proteins when that epitope subsequence repeatedly participates in novel packing interactions.

To calculate the whether a given epitope subsequence appears in crystal packing interfaces more frequently than expected by chance, each epitope subsequences' count must be calibrated against the total number of occurrences of that subsequence in the sequence space of the PDB, and against the variable probability of finding any given amino acid or amino acid sequence on the protein's surface rather than in the interior. For an epitope subsequence with interaction mask m (such as XX or XxxxX), primary and secondary sequence i (such as "ExxxR HhhhH" ("ExxxR" disclosed as SEQ ID NO: 50)) and surface exposure profile s (such as SIIIS), its redundancy-weighted count in crystal packing interfaces is e_msi (the "epitope subsequence" count) and its redundancy-weighted count in the sequence space is p_msi (the "prior" count). The surface profile is calculated by DSSP, which uses a quantitative cut-off for designation of interior residues, allowing up to 15% of their surface area to be solvent exposed. Because of this uncertainty, about 10% of all residues participating in packing contacts are designated as interior. Since the surface profile designations are variable and to some degree arbitrary, they need to be abstracted away using the "surface-expected" method, which predicts how frequently a epitope subsequence would participate in crystal packing interactions if the surface profile bias was removed. The total number of occurrences of a epitope subsequence with interaction mask m and sequence i in interactions is the sum of the counts across all possible surface profiles:

$$e\_mi = \Sigma\_se\_msi$$

While the prior count of a epitope subsequence with mask m and sequence i is accordingly:

$$p\_mi = \Sigma\_sp\_msi$$

The expected number of occurrences of the given epitope subsequence in interactions depends on the frequency of occurrences of all epitope subsequences with the same interaction mask and surface profile, summed across all possible surface profiles:

$$E(e\_mi) = \Sigma\_i[(\Sigma\_je\_msj)/(\Sigma\_jp\_msj) * p\_msi]$$

Finally, the probability that the calculated epitope subsequence count could have been observed by chance can be calculated by integrating the upper tail of the binomial distribution B(n, p, k) where:

$$k\_mi = e\_mi,$$

$$n\_mi = p\_mi, \text{ and}$$

$$p\_mi = E(e\_mi)/p\_mi.$$

If the calculated probability is below the Bonferonni-corrected significance level of 5%, the given epitope subsequence is designated to be "over-represented", and its over-representation ratio is equal to:

$$e\_mi/E(e\_mi).$$

The initial analysis conducted using these methods evaluated all possible secondary-structure-specific epitopes subsequences in protein segments from two to six residues in length. The interacting residues in the epitope subsequence had to occur in a single EBIE, while both the interacting and non-interacting residues had to match the secondary-structure pattern at every position. This analysis covers 31 different interaction masks giving a total of over 57 billion possible secondary-structure-specific sub-epitopes. However, only 54,317,358 of these actually occur in crystal structures in the PDB, so this number was used as the correction factor for multiple-hypothesis testing. After applying this correction, 2,040 of these secondary-structure-specific epitope subsequences are over-represented at a Bonferroni-corrected 5% significance level of $9.2 \times 10^{-10}$, while also meeting a small set of additional selection criteria (at least 10 redundancy-corrected counts in epitopes, no more than 50% of occurrences involving non-water bridging solvent species, and at least a 1.5 ratio of redundancy-corrected observed vs. expected counts in epitopes).

Table 37 shows the eight top-ranked secondary-structure-specific epitope subsequences in two classes of interest, continuous dimers (XX mask) and dimers separated by four residues (XxxxX mask).

TABLE 37[a]

(SEQ ID NOS 42-57, respectively, in order of appearance)

| Sequence | Secondary structure | Redundancy-corrected counts | Non-homologous chains | P-value | Over-representation ratio | Fraction in epitopes | Fraction non-H$_2$O solvent | % identity in partner epitopes |
|---|---|---|---|---|---|---|---|---|
| LP | CC | 3645 | 2421 | 5.0e−79 | 1.3 | 0.18 | 0.18 | 12% |
| GY | CC | 1961 | 1241 | 1.6e−67 | 1.4 | 0.22 | 0.24 | 12% |
| PN | CC | 2685 | 1612 | 3.9e−62 | 1.3 | 0.27 | 0.19 | 13% |
| GK | CH | 497 | 277 | 1.7e−61 | 2.0 | 0.24 | 0.74 | 12% |
| DG | CC | 5443 | 2805 | 7.2e−58 | 1.2 | 0.25 | 0.16 | 13% |
| PG | CC | 5008 | 2600 | 1.3e−57 | 1.2 | 0.25 | 0.17 | 12% |
| GF | CC | 1763 | 1216 | 1.0e−55 | 1.4 | 0.19 | 0.21 | 12% |
| NG | CC | 4062 | 2226 | 2.7e−54 | 1.2 | 0.25 | 0.18 | 12% |
| ExxxR | HhhhH | 3547 | 2041 | 0.0 | 2.1 | 0.28 | 0.18 | 15% |
| RxxxE | HhhhH | 2928 | 2328 | 0.0 | 2.2 | 0.26 | 0.17 | 15% |
| QxxxD | HhhhH | 1522 | 1141 | 1.3e−272 | 2.3 | 0.27 | 0.13 | 13% |
| RxxxR | HhhhH | 1627 | 1078 | 1.1e−271 | 2.2 | 0.28 | 0.23 | 15% |
| ExxxE | HhhhH | 2968 | 1998 | 1.6e−251 | 1.8 | 0.23 | 0.16 | 15% |
| DxxxR | HhhhH | 1593 | 1128 | 4.1e−246 | 2.2 | 0.26 | 0.17 | 14% |
| ExxxQ | HhhhH | 1904 | 1395 | 3.0e−228 | 2.0 | 0.24 | 0.16 | 14% |
| AxxxR | HhhhH | 1717 | 1299 | 3.6e−186 | 1.9 | 0.17 | 0.19 | 14% |

[a]"Sequence" is the string of amino acid letter codes, with capital letters indicating amino acid participating in interactions, and lower-case x's indicating intervening residues (which may or may not be interacting as well). "Secondary structure" indicates structure letter codes (H = helix, E = sheet, C = coil). "Redundancy-corrected counts" is calculated as described in above. "Non-homologous chains" is the number of chain homology sets in which the epitope can be found in interactions (a chain homology set contains all protein chains that have greater than 25% sequence identity). "P-value" and "over-representation ratio" are calculated as described above. "Fraction in epitopes" is the ratio of the observed redundancy-weighted surface-profile-summed epitope count to the observed prior count. "Fraction non-water solvent" is the fraction of the total redundancy-weighted number of occurrences of the epitope that participate in inter-protein interactions bridged by a solvent molecule other than water, such as salt ions or nucleotides (ATP). "% id partner epitopes" is the average sequence identity of the partner epitopes of this epitope - the strings of amino acid letter codes corresponding to the residues of the protein with which the residues of the given epitope interact in every interface in which the epitope appears.

Evaluation of these classes is informative for several reasons, including the fact their P-values can be compared directly because they have an equivalent number of occurrences in the PDB. The most over-represented epitope subsequences in the two classes contain different residues, indicating that our statistical methods give results sensitive to local stereochemistry and not merely the amino acid composition. The top-ranking continuous dimers are enriched in Gly residues in loops, consistent with prediction from our earlier crystallization datamining studies that such residues are enriched in packing interfaces (Price et al., *Understanding the physical properties that control protein crystallization by analysis of large-scale experimental data. Nat Biotechnol* 27 (1), 51-7 (2009)).

Remarkably, dimers separated by four residues are enriched in high-entropy, charged amino acids located on the surfaces of α-helices or in their capping motifs. Given these relative locations, the high-entropy side-chains are likely to be entropically restricted by mutual salt-bridging or hydrogen-bonding (H-bonding) interactions within the secondary-structure specific epitope subsequence. Immobilization of these high-entropy side-chains by local tertiary interactions in the native structure of a protein enables them to participate in crystal-packing interactions without incurring the entropic penalty associated with their immobilization from a disordered conformation on the surface of the protein.

Simple Local Structural Motifs Represent Highly Promising Candidates for Engineering Improved Protein Crystallization Behavior Based on Novel Amino-Acid Substitutions Certain local structural motifs are highly polar and therefore much less likely than hydrophobic substitutions to reduce protein solubility, which is a major problem with the Surface Entropy Reduction method (Cooper et al., *Protein crystallization by surface entropy reduction: optimization of the SER strategy. Acta crystallographica,* 63 (Pt 5), 636-45 (2007); Derewenda and Vekilov, *Entropy and surface engineering in protein crystallization. Acta crystallographica* 62 (Pt 1), 116-24 (2006); Longenecker et al., *Protein crystallization by rational mutagenesis of surface residues: Lys to Ala mutations promote crystallization of RhoGDI. Acta crystallographica,* 57 (Pt 5), 679-88 (2001)). Second, they occur in secondary-structure motifs that are reliably classified by standard prediction algorithms, both in terms of their location and their solvent exposure status. Therefore, epitope-engineering efforts should be able to efficiently target the most promising regions of the subject protein, even when its tertiary structure is unknown. Third, it is reassuring that the sub-epitopes in both classes in Table 37 interact with partner epitopes with highly diverse sequences, consistent with our goal of engineering the surface of a protein to have higher interaction probability (i.e., rather than attempting to engineer specific pair-wise packing interactions). Table 38 only shows a small fraction of the statistically over-represented secondary-structure-specific sub-epitopes in the PDB. The full set in Table 37 (Appendix A) covers a much wider variety of sequences and secondary structures, although many of them echo similar physiochemical themes.

Epitope-Engineering Software

Software was written to determine all possible ways that the statistically over-represented epitope subsequences described above can be introduced into a target protein consistent with the sequence profile of the corresponding functional family (FIG. 1). The program takes two input files, one a FASTA-formatted file with a set of homologous protein sequences (with the target protein at the top) and the other the secondary-structure prediction output from PHD/PROF. After using ClustalW to align the homologs, the software systematically analyzes the locations where any of the sub-epitopes can be engineered into the target protein consistent with two criteria.

First, based on the PHD/PROF prediction, the secondary structure at the site of mutagenesis must be likely to match that of the sub-epitope. This restriction increases the probability that the engineered sub-epitope will have a local tertiary structure similar to the over-represented sub-epitopes in the PDB.

Second, in one embodiment, the engineered epitope subsequence contains exclusively amino acids observed to occur at the equivalent position in one of the homologs. In another embodiment, the engineered epitope subsequence is filtered to not contain residues anti-correlated in homologs with other amino acids in the target sequence, as determined using the "correlated evolution" metrics described above. Restricting epitope mutations to substitutions observed in a homolog should reduce the chance that the mutations will impair protein stability. In yet another embodiment, the engineered epitope subsequence is not restricted at all based on homolog sequence, and a greater risk of protein destabilization is tolerated. The computer program returns a comma-separated-value file containing a list of candidate epitope-engineering mutations along with statistics characterizing each epitope subsequence. While this list is sorted according to over-representation P-value, it is readily resorted according to user criteria in any standard spreadsheet program. For a target protein ~200 residues in length with ~20 homologous sequences, the program typically returns several hundred candidate mutations. However, longer proteins or proteins with more homologs can yield lists containing thousands of candidate mutations.

Methods for Protein Expression

Strategies and techniques for expressing a protein of interest or a modified protein, for producing nucleic acids encoding a protein of interest or a modified protein are well-known in the art and can be found, e.g., in Berger and Kimmel, Guide to Molecular Cloning Techniques, *Methods In Enzymology* Vol. 152 Academic Press, Inc., San Diego, Calif. and in Sambrook et al., *Molecular Cloning-A Laboratory Manual* (2nd ed.) Vol. 1-3 (1989) and in *Current Protocols In Molecular Biology*, Ausubel, F. M., et al., eds., Greene Publishing Associates, Inc. and John Wiley & Sons, Inc., (1996 Supplement).

Expression systems suitable for use with the methods described herein include, but are not limited to in vitro expression systems and in vivo expression systems. Exemplary in vitro expression systems include, but are not limited to, cell-free transcription/translation systems (e.g., ribosome based protein expression systems). Several such systems are known in the art (see, for example, Tymms (1995) *In vitro Transcription and Translation Protocols Methods in Molecular Biology* Volume 37, Garland Publishing, NY).

Exemplary in vivo expression systems include, but are not limited to prokaryotic expression systems such as bacteria (e.g., *E. coli* and *B. subtilis*), and eukaryotic expression systems including yeast expression systems (e.g., *Saccharomyces cerevisiae*), worm expression systems (e.g. *Caenorhabditis elegans*), insect expression systems (e.g. Sf9 cells), plant expression systems, amphibian expression systems (e.g. melanophore cells), vertebrate including human tissue culture cells, and genetically engineered or virally infected whole animals.

Methods Fore Determining Solubility of a Protein

Methods for determining the solubility of a protein are known in the art. For example, a recombinant protein can be isolated from a host cell by expressing the recombinant protein in the cell and releasing the polypeptide from within the cell by any method known in the art, including, but not limited to lysis by homogenization, sonication, French press, microfluidizer, or the like, or by using chemical methods such as treatment of the cells with EDTA and a detergent (see Falconer et al., *Biotechnol. Bioengin.* 53:453-458 [1997]). Bacterial cell lysis can also be obtained with the use of bacteriophage polypeptides having lytic activity (Crabtree and Cronan, J. E., *J. Bact.,* 1984, 158:354-356).

Soluble materials can be separated form insoluble materials by centrifugation of cell lysates (e.g. 18,000×G for about 20 minutes). After separation of lysed materials into soluble and insoluble fractions, soluble protein can be visualized by using denaturing gel electrophoresis. For example, equivalent amount of the soluble and insoluble fractions can be migrated through the gel. Proteins in both fractions can then be detected by any method known in the art, including, but not limited to staining or by Western blotting using an antibody or any reagent that recognizes the recombinant protein.

Protein Purification

Proteins can also be isolated from cellular lysates (e.g. prokaryotic cell lysates or eukaryotic cell lysates) by using any standard technique known in the art. For example, recombinant polypeptides can be engineered to comprise an epitope tag such as a Hexahistidine ("hexaHis") tag (SEQ ID NO: 5,227) or other small peptide tag such as myc or FLAG. Purification can be achieved by immunoprecipitation using antibodies specific to the recombinant peptide (or any epitope tag comprised in the amino sequence of the recombinant polypeptide) or by running the lysate solution through an affinity column that comprises a matrix for the polypeptide or for any epitope tag comprised in the recombinant protein (see for example, Ausubel et al., eds., *Current Protocols in Molecular Biology*, Section 10.11.8, John Wiley & Sons, New York [1993]).

Other methods for purifying a recombinant protein include, but are not limited to ion exchange chromatography, hydroxylapatite chromatography, hydrophobic interaction chromatography, preparative isoelectric focusing chromatography, molecular sieve chromatography, HPLC, native gel electrophoresis in combination with gel elution, affinity chromatography, and preparative isoelectric. See, for example, Marston et al. (*Meth. Enz.,* 182:264-275 [1990]).

Screening of Modified Proteins for Crystallization

Initial high-throughput crystallization screening can be conducted using methods known in the art, for example manually or using the 1,536-well microbatch robotic screen at the Hauptmann-Woodward Institute (Cumbaa et al., *Automatic classification of sub-microliter protein-crystallization trials in* 1536-*well plates. Acta Crystallogr.* 59, 1619-1627 (2003)). Proteins failing to yield rapidly progressing crystal leads can be subjected to vapor diffusion screening, typically 300-500 conditions (e.g., Crystal Screens I & II, PEG-Ion and Index screens from Hampton Research or equivalent screens from Qiagen) at either 4° C., 20° C. or both. Screening can be conducted in the presence of substrate or product compounds If commercially available. Screening can also be conducted using the target protein as a control to evaluate the effect of the introduction of an epitope or multiple epitopes on the crystallization properties of the target protein.

All patents, patent applications and publications cited herein are hereby incorporated by reference in their entirety. The disclosures of these publications in their entireties are hereby incorporated by reference into this application in order to more fully describe the state of the art as known to those skilled therein as of the date of the invention described herein.

The following examples illustrate the present invention, and are set forth to aid in the understanding of the invention, and should not be construed to limit in any way the scope of the invention as defined in the claims which follow thereafter.

EXAMPLES

This invention is further illustrated by the following examples, which should not be construed as limiting. Those skilled in the art will recognize, or be able to ascertain, using no more than routine experimentation, numerous equivalents to the specific substances and procedures described herein. Such equivalents are intended to be encompassed in the scope of the claims that follow the examples below.

Figure 8:
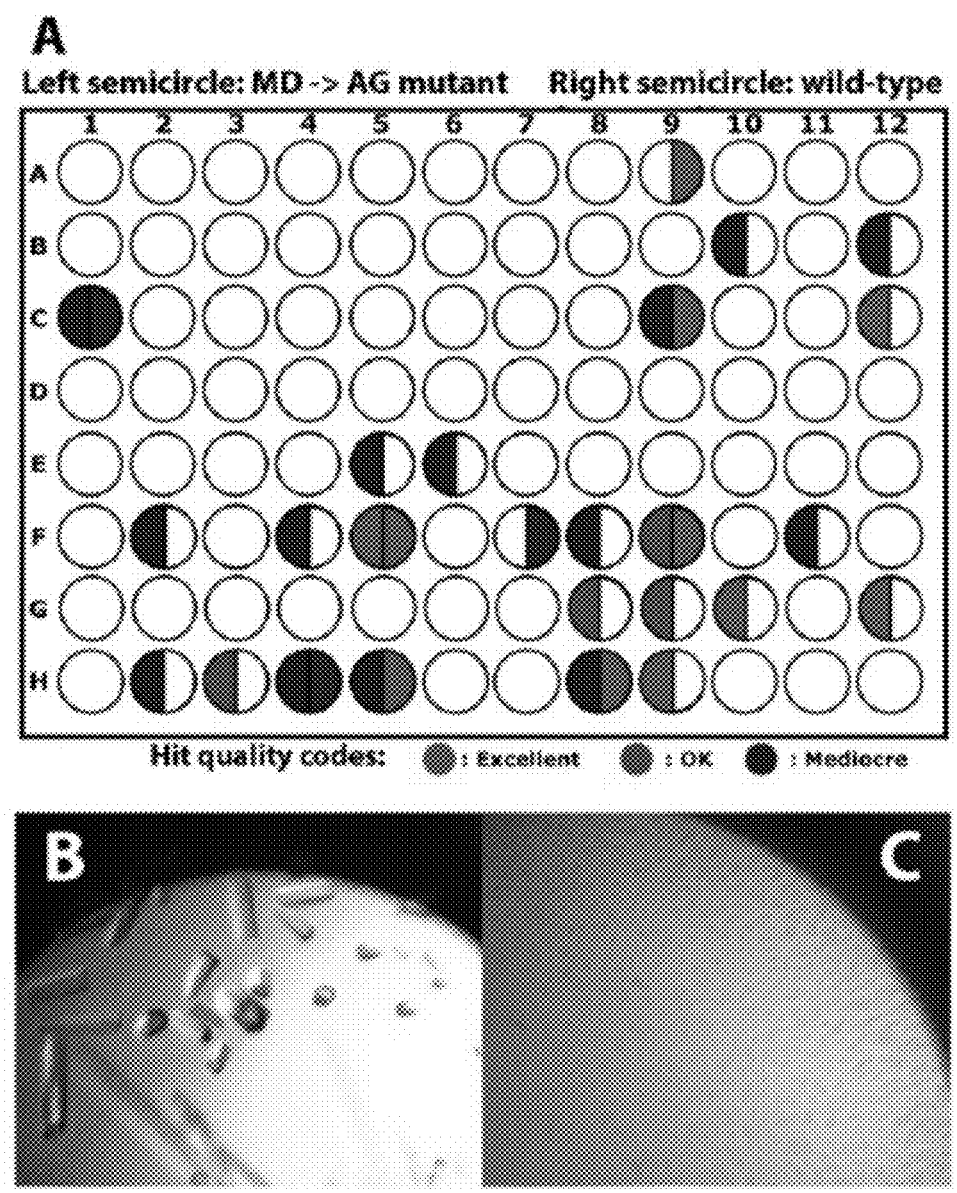
FIG. 8 illustrates improvement of crystallization of an integral membrane protein via epitope engineering. (A) Schematic summary of the results from a representative initial crystallization screen at 20° C. (B) Micrograph of one well of excellent lead crystals obtained for the MD-to-AG mutant protein in this screen. (C) The same well from a wild-type screen conducted in parallel.

Example 1—Introduction of Residues from an Observed Crystal-Packing Epitope Improves Crystallization of an Integral Membrane Protein FIG. 8 shows representative results from an initial attempt to employ a previously observed crystallization epitope to improve the crystallization of a difficult protein.

FIG. 8A is a schematic summary of the results from a representative initial crystallization screen at 20° C. The MD-to-AG mutant yielded 5 excellent hits and 23 total hits, compared to 1 and 8, respectively, for the wild-type protein. FIG. 8B is a micrograph of one well of excellent lead crystals obtained for the MD-to-AG mutant protein (described below) in this screen. FIG. 8C is the same well from a wild-type screen conducted in parallel.

The subject of this study was a polytopic integral membrane protein from *E. coli* called B0914 whose wild-type sequence only yields poor crystals. Manual inspection of a crystal structure of a remote homologue (Dawson and Locher, *Structure of a bacterial multidrug ABC transporter. Nature* 443 (7108), 180-5 (2006)) revealed that an Ala-Gly (AG) dipeptide in a periplasmic loop formed part of a crystal-packing interaction. Because the frequency of these two residues correlates most strongly with successful crystal structure determination in our published datamining studies, it was hypothesized that this dipeptide could be used to engineer improved crystallization of another protein. This sub-epitope ranks $20^{th}$ among the 400 possibilities in the analysis of over-represented continuous dimers.

The sub-epitope was introduced into one of the periplasmic loops in protein B0914, at a site with the sequence met-asp (MD) but where the sequence AG is found in a homolog. This MD-to-AG mutant protein yields more hits and more high quality hits in initial crystallization screens (FIG. 8). Importantly, improved crystallization is obtained even though the interaction partner of the AG epitope from the existing structure was not introduced into the target protein. A second mutant protein containing a similarly chosen crystallization epitope that was not observed in a homologous protein failed to produce properly folded protein, while a series of single-residue substitutions chosen based on different criteria yielded inferior results, including several substitutions recommended by the standard Surface Entropy Reduction algorithm.

Example 2—Generation of Modified Proteins with Epitopes that Increase Protein Crystallization Amino acid sequences of 13 genes were provided to the server. The amino acid sequences were:

BhR182-21.1
(SEQ ID NO: 1)
MIIREATVQDYEEVARLHTQVHEAHVKERGDIFRSNEPTLNPSFFQAAVQGEKSTVLVFV

DEREKIGAYSVIHLVQTPLLPTMQQRKTVYISDLCVDETRRGGGIGRLIFEAIISYGKAH

QVDAIELDVYDFNDRAKAFYHSLGMRCQKQTMELPLLEHHHHHH

ChR11B-227-489-21.2
(SEQ ID NO: 2)
NDDVEFRYADFLFKNNNYAEAIEVFNKLEAKKYNSPYIYNRRAVCYYELAKYDLAQKDIE

TYFSKVNATKAKSADFEYYGKILMKKGQDSLAIQQYQAAVDRDTTRLDMYGQIGSYFYNK

GNFPLAIQYMSKQIRPTTTDPKVFYELGQAYYYNKEYVKADSSFVKVLELKPNIYIGYLW

RARANAAQDPDTKQGLAKPYYEKLIEVCAPGGAKYKDELIEANEYIAYYYTINRDKVKAD

AAWKNILALDPTNKKAIDGLKMKLEHHHHHH

CvR75A-1-152-21.17
(SEQ ID NO: 3)
MKKVYIKTFGCQMNEYDSDKMADVLGSAEGMVKTDNPEEADVILFNTCSVREKAQEKVFS

DLGRIRPLKEANPDLIIGVGGCVASQEGDAIVKRAPFVDVVFGPQTLHRLPDLIESRKQS

GRSQVDISFPEIEKFDHIPPAKVDGGAAFVSILEHHHHHH

EcoxPrrC
(SEQ ID NO: 4)
MGKTLSEIAQQLSTPQKVKKTVHKEVEATRAVPKVQLIYAFNGTGKTRLSRDFKQLLESK

VHDGEGEDEAEQSALSRKKILYYNAFTEDLFYWDNDLQEDAEPKLKVQPNSYTNWLLTLL

KDLGQDSNIVRYFQRYANDKLTPHFNPDFTEITFSMERGNDERSAHIKLSKGEESNFIWS

VFYTLLDQVVTILNVADPDARETHAFDQLKYVFIDDPVSSLDDNHLIELAVNLAGLIKSS

ESDLKFIITTHSPIFYNVLFNELNGKVCYMLESFEDGTFALTEKYGDSNKSFSYHLHLKQ

TIEQAIADNNVERYHFTLLRNLYEKTASFLGYPKWSELLPDDKQLYLSRIINFTSaSTLS

NEAVAEPTPAEKATVKLLLDHLKNNCGFWQQEQKNG

ER247A-21.2
(SEQ ID NO: 5)
MNETAVYGSDENIIFMRYVEKLHLDKYSVKNTVKTETMAIQLAEIYVRYRYGERIAEEEK

PYLITELPDSWVVEGAKLPYEVAGGVFIIEINKKNGCVLNFLHSKLEHHHHHH

ER40-21-mgk
(SEQ ID NO: 6)
MSDDNSHSSDTISNKKGFFSLLLSQLFHGEPKNRDELLALIRDSGQNDLIDEDTRDMLEG

VMDIADQRVRDIMIPRSQMITLKRNQTLDECLDVIIESAHSRFPVISEDKDHIEGILMAK

DLLPFMRSDAEAFSMDKVLRQAVVVPESKRVDRMLKEFRSQRYHMAIVIDEFGGVSGLVT

IEDILELIVGEIEDEYDEEDDIDFRQLSRHTWTVRALASIEDFNEAFGTHFSDEEVDTIG

GLVMQAFGHLPARGETIDIDGYQFKVAMADSRRIIQVHVKIPDDSPQPKLDELEHHHHHH

EwR161-21.1
(SEQ ID NO: 7)
MQSFDVVIAGGGMVGLALACGLQGSGLRIAVLEKQAAEPQTLGKGHALRVSAINAASECL

LRHIGVWENLVAQRVSPYNDMQVWDKDSFGKISFSGEEFGFSHLGHIIENPVIQQVLWQR

ASQLSDITLLSPTSLKQVAWGENEAFITLQDDSMLTARLVVGADGAHSWLRQHADIPLTF

WDYGHHALVANIRTEHPHQSVARQAFHGDGILAFLPLDDPHLCSIVWSLSPEQALVMQSL

PVEEFNRQVAMAFDMRLGLCELESERQTFPLMGRYARSFAAHRLVLVGDAAHTIHPLAGQ

GVNLGFMDVAELIAELKRLQTQGKDIGQHLYLRRYERRRKHSAAVMLASMQGFRELFDGD

NPAKKLLRDVGLVLADKLPGIKPTLVRQAMGLHDLPDWLSAGKLEHHHHHH

```
HR4403-86-543-14.1
                                                       (SEQ ID NO: 8)
MGHHHHHHSHMNRFEEAKRTYEEGLKHEANNPQLKEGLQNMEARLAERKFMNPFNMPNLYQ

KLESDPRTRTLLSDPTYRELIEQLRNKPSDLGTKLQDPRIMTTLSVLLGVDLGSMDEEE

EIATPPPPPPPKKETKPEPMEEDLPENKKQALKEKELGNDAYKKKDFDTALKHYDKAKEL

DPTNMTYITNQAAVYFEKGDYNKCRELCEKAIEVGRENREDYRQIAKAYARIGNSYFKEE

KYKDAIHFYNKSLAEHRTPDVLKKCQQAEKILKEQERLAYINPDLALEEKNKGNECFQKG

DYPQAMKHYTEAIKRNPKDAKLYSNRAACYTKLLEFQLALKDCEECIQLEPTFIKGYTRK

AAALEAMKDYTKAMDVYQKALDLDSSCKEAADGYQRCMMAQYNRHDSPEDVKRRAMADPE

VQQIMSDPAMRLILEQMQKDPQALSEHLKNPVIAQKIQKLMDVGLIAIR

KR127C-21.3
                                                       (SEQ ID NO: 9)
IDNPTPKSSMTFKELYDEWLLVYEKEVQNSTYYKTTRAFEKHVLPVIGSTKLSDFTPMEL

QNFRNDLSEKLKFARKLFGMVRKVFNHAALLSYIQANPALPVTSQGIKLEHHHHHH

MaR262-21.1
                                                      (SEQ ID NO: 10)
MPESYWEKVSGKNIPSSLDLYPIIHNYLQEDDEILDIGCGSGKISLELASLGYSVTGIDI

NSEAIRLAETAARSPGLNQKTGGKAEFKVENASSLSFHDSSFDFAVMQAFLTSVPDPKER

SRIIKEVFRVLKPGAYLYLVEFGQNWHLKLYRKRYLHDFPITKEEGSFLARDPETGETEF

IAHHFTEKELVFLLTDCRFEIDYFRVKELETRTGNKILGFVIIAQKLLEHHHHHH

IMRFYGADDAIQSGEYQMPEIKVVK

PaeKu
                                                      (SEQ ID NO: 11)
MARAIWKGAISFGLVHIPVSLSAATSSQGIDFDWLDQRSMEPVGYKRVNKVTGKEIEREN

IVKGVEYEKGRYVVLSEEEIRAAHPKSTQTIEIFAFVDSQEIPLQHFDTPYYLVPDRRGG

KVYALLRETLERTGKVALANVVLHTRQHLALLRPLQDALVLITLRWPSQVRSLDGLELDE

SVTEAKLDKRELEMAKRLVEDMASHWEPDEYKDSFSDKIMKLVEEKAAKGQLHAVEEEEE

VAGKGADIID
```

Each target sequence was then entered into the protein crystallization server, along with a PROF secondary structure prediction and a FASTA file containing about 50 homologous protein sequences for each target.

Criteria used to select the epitope subsequences expected to improve crystallizability of the proteins included: (1) prioritization by overrepresentation ratio, using P-value cut-off; (2) prioritization of mutations improving over-representation ratio at a given site (i.e., avoiding removing an epitope subsequence with a better ratio than the new epitope subsequence); (3) prioritization of epitope subsequences observed in packing interactions in at least 50 sequence-unrelated proteins ("chainsets" as defined above) in the PDB; and (4) favoring of substitutions maintaining or increasing polarity over those reducing polarity.

The server outputted several hundred possible mutations that introduce one epitope from the epitope library at some position in the protein sequence, with considerations given to primary and secondary structure conservation. The output list was ranked by the over-representation ratio of each candidate epitope.

The researchers went down the list and use their knowledge of the target protein's biophysics and biochemistry to guide their selection of epitopes, skipping epitopes that they believe would endanger the protein's biological activity or structural stability. The researchers decide whether they want to introduce a small and simple or a larger and more complex epitope, and whether the suggested epitope mutation is better than any existing epitope it replaces. In addition to these constraints, the researchers use the epitopes' over-representation ratios, P-values, in-epitopes fractions, non-homologous chainset counts, and non-water solvent fractions to decide which epitopes are better for the given situation. The researchers are able to pick a few, several, or many mutations from the candidates list to engineer in parallel, depending on the available resources and the degree of importance of obtaining a structure.

Some of the engineered proteins and the recommended epitopes chosen for protein expression and crystallization studies are shown in Table 38.

TABLE 38

("Original Sequence" peptides disclosed as SEQ ID NOS 58-86 and "Sub-epitope" peptides disclosed as SEQ ID NOS 87-117, all respectively, in order of appearance.)

| ID Number | Gene | Sequence Position | Original Sequence | Sub-epitope* |
|---|---|---|---|---|
| 42 | BhR182 | 11 | YEEVA | YxxxN/HHHHH |
| 43 | BhR182 | 134 | DRAKA | ExxxR/HHHHH |
| 44 | BhR182 | 39 | TLNPSF | TxxxxR/CCHHHH |
| 45 | BhR182 | 12 | EEVAR | YxxxR/HHHHH |
| 46 | BhR182 | 97 | DETRRG | DxxGxG/CCCCCC |
| 2 | CvR75A | 90 | AIVKR | ExxxR/HHHHH |
| 13 | CvR75A | 19 | DKMAD | ExxxR/HHHHH |
| 14 | CvR75A | 65 | IRPLK | YxxxQ/HHHHH |
| 15 | CvR75A | 64 | RIRP | RxxE/HHHH |
| 3 | ER40 | 93 |  | KxxxE |
| 20 | ER40 | 19 | FSLLL | FxxxQ/HHHHH |
| 21 | ER40 | 38 | LALIR | ExxxR/HHHHH |
| 22 | ER40 | 245 | QAFG | SAxG/HHHC |
| 1 | HR4403 | 354 | IKGYT | ISxxT/CCHHH |
| 4 | KR127C | 106 |  | YKTEN |
| 27 | KR127C | 76 | KLFGM | YxxxM/HHHHH |
| 28 | KR127C | 55 | FTPME | LTxxE/CCHHH |
| 29 | KR127C | 101 | PVTSQG | DxxGxG/CCCCCC |
| 7 | MaR262 | 38 | GCGSG | ACxxG |
| 8 | MaR262 | 129 | RVLKPG | RxxxPE |
| 9 | MaR262 | 48 | LASLGY | LxxKxY |
| 18 | MaR262 | 188 | KELVF | KxxxE |
| 6 | SiR159 | 90 | RMRAR | RxxxH/HHHHH |
| 38 | SiR159 | 44 | KSLG | SxxG/ECCE |
| 39 | SiR159 | 340 | ARCG | RxxG/HHCC |
| 40 | SiR159 | 32 | SQDAG | SxxxH/HHHHH |
| 41 | SiR159 | 140 | ADAPVQ | LxxxxQ/CCHHHH |
| 5 | VpR106 | 233 | KQWLD | QxxxD/HHHHH |
| 16 | VpR106 | 57 | PLNRFQ | LxxxxQ/CCHHHH |
| 17 | VpR106 | 60 | RFQNI | ExxxR/HHHHH |
| 19 | VpR106 | 42 | EAYKF | ExxxR/HHHHH |

*Includes secondary structure class: H = helix, E = β-strand and C is coil.

Example 3—Protein Expression and Crystallization Screening

Proteins from Example 2 are expressed, purified, concentrated to 5-12 mg/ml, and flash-frozen in small aliquots as described in Acton et al., *Robotic cloning and Protein Production Platform of the Northeast Structural Genomics Consortium. Methods in Enzymology* 394, 210-243 (2005). All proteins contain short 8-residue hexa-histidine purification tags (SEQ ID NO: 5,227) at their N- or C-termini and are metabolically labeled with selenomethionine. Matrix-assisted laser-desorption mass spectrometry is used to verify construct molecular weight. All proteins are ≥95% pure based on visual inspection of Coomasie Blue stained SDS- PAGE gels. The distribution of hydrodynamic species in the protein stock is assayed using static light-scattering and refractive index detectors (Wyatt, Inc., Santa Barbara, Calif.) to monitor the effluent from analytical gel filtration chromatography in 100 mM NaCl, 0.025% (w/v) NaN$_3$, 100 mM Tris-Cl, pH 7.5, on a Shodex 802.5 column (Showa Denko, Tokyo, Japan). Protein samples are flash frozen in liquid nitrogen in small aliquots prior to crystallization or biophysical characterization. Oligomeric state is inferred from the molecular weight determined by Debye analysis of the light-scattering data (Price et al., *Understanding the physical properties that control protein crystallization by analysis of large-scale experimental data. Nat Biotechnol* 27 (1), 51-7 (2009)).

Initial high-throughput crystallization screening is conducted using the 1,536-well microbatch robotic screen at the Hauptmann-Woodward Institute (Cumbaa et al., *Automatic classification of sub-microliter protein-crystallization trials in* 1536-*well plates. Acta Crystallogr.* 59, 1619-1627 (2003)). Proteins failing to yield rapidly progressing crystal leads are subjected to vapor diffusion screening, typically 300-500 conditions (Crystal Screens I & II, PEG-Ion and Index screens from Hampton Research or equivalent screens from Qiagen) at both 4° C. and 20° C. Screening is conducted in the presence of substrate or product compounds if commercially available.

Crystal optimization, diffraction data collection at cryogenic temperatures, structure solution using single or multiple-wavelength anomalous diffraction techniques and refinement are conducted using standard methods.

Example 4—Analysis of Intermolecular Packing Interactions in the Protein Data Bank to Guide Rational Engineering of Protein Crystallization X-ray crystallography is the dominant method for solving protein structures, but despite decades of methodological improvement, most proteins do not yield solvable crystals. Even when selected using the best algorithms available, at most 60% of proteins give crystals of any kind, and no more than 35% give crystals which can be solved. The reasons for this low success rate remain obscure due to our limited understanding of crystallization itself. A better understanding of crystallization is required to identify both problematic areas of the process and potential solutions to this critical barrier. Working within this framework, and as described herein, is a characterization the stereochemical features of crystal packing interactions to guide rational engineer protein sequences to improve crystallization. Described herein is a rigorous parsing of all protein crystal structures in the Protein Data Bank (PDB) to identify and characterize crystal packing patterns. All residues within a minimum contact distance between chains are identified and then grouped into an ascending hierarchy ranging from the simplest elementary binary interacting epitopes to complete binary interprotein interaction interfaces. For counting and averaging purposes, protein chains are redundancy-downweighted to account for homologous chains forming similar crystals, as evaluated by a dot-product-like Packing Similarity Score. Also described herein is an identification of sequences which appear disproportionately frequently in packing interfaces relative to their background frequency in the PDB. These overrepresented sequences are more efficacious at forming favorable packing interactions, and therefore offer attractive possibilities for new engineering approaches to enhance protein crystallizability.

More than 50 years after the solution of the first protein crystal structure Kendrew, et al., *Nature* 1958, 181 (4610), 662-6), protein crystallization remains a hit-or-miss proposition. However, as long as most proteins cannot be crystallized, crystallization fundamentally remains a hit-or-miss proposition. Synergistic developments in crystallographic methods, synchrotron beamlines, and high-speed computing have made structure solution and refinement routine, even for very large complexes, as long as high-quality crystals are available. However, there has been comparatively little progress in improving methods for protein crystallization. Recent work by structural genomics (SG) consortia has systematically confirmed that most naturally occurring proteins do not readily yield high-quality crystals suitable for x-ray structure determination and that crystallization is the major obstacle to the determination of protein structures using diffraction methods (Canaves, et al., *Journal of molecular biology* 2004, 344 (4), 977-91; Slabinski, et al., *Protein Sci* 2007, 16 (11), 2472-82). Many impressive technological innovations during the last 20 years have simplified and streamlined the work involved in protein crystallization. These include the development of highly efficacious chemical screens that mimic historically successful crystallization conditions (Price, et al., *Nat Biotechnol* 2009, 27 (1), 51-7), sophisticated robotics that enable more crystallization conditions to be screened with less protein and effort (Cooper, et al., *Acta crystallographica* 2007, 63 (Pt 5), 636-45; Derewenda, *Methods* 2004, 34 (3), 354-63), and numerous other clever innovations that improve the crystallization process in some cases. Even with these advances, only approximately ⅓ of proteins with even the most promising sequence properties yield crystal structures from a single protein construct.

Existing methods for engineering improved protein crystallization work with limited efficiency. Consistent with this premise, changes in primary sequence have been demonstrated to substantially alter the crystallization properties of many proteins (Derewenda, *Acta crystallographica* 2006, 62 (Pt 1), 116-24; Stanley, *Science* (New York, N.Y. 1935, 81 (2113), 644-645). Disordered backbone segments can be identified using elegant hydrogen-deuterium exchange mass spectrometry methods, and genetically engineered constructs with such segments excised have shown improved crystallization properties (Edsall, *Journal of the history of biology* 1972, 5 (2), 205-57). Progressive truncation of the N- and C-termini of the protein can also yield crystallizable constructs of proteins that initially failed to crystallize (Hunt and Ingram, *Nature* 1958, 181 (4615), 1062-3). However, many nested truncation constructs generally need to be screened, sometimes with termini differing by as little as two amino acids, and this procedure still frequently fails to yield a soluble protein construct producing high-quality crystals. The Surface Entropy Reduction (SER) method developed by Derewenda and co-workers uses site-directed mutagenesis to replace high-entropy side chains on the surface of the protein (generally lysine, glutamate, and glutamine) with lower entropy side chains (generally alanine) (Derewenda, *Acta crystallographica* 2006, 62 (Pt 1), 116-24; Stanley, *Science* (New York, N.Y. 1935, 81 (2113), 644-645; Lessin, et al., *J Exp Med* 1969, 130 (3), 443-66). In most cases in which a substantial improvement in crystallization has been obtained by this method, a pair of such mutations were introduced at adjacent sites. While some spectacular successes have been obtained this way, most such mutations reduce the solubility of the protein, frequently so severely that a high quality protein preparation can no longer be obtained. Most attempts to employ this technique in the Hunt lab have resulted in production of insoluble protein (unpublished results). The Derewenda group has also evaluated the use of amino acids other than alanine to replace high-entropy side chains (Derewenda, Acta crystallographica 2006, 62 (Pt 1), 116-24; Kendrew, et al., *Proc R Soc Lond A Math Phys Sci* 1948, 194 (1038), 375-98). These substitutions frequently change the crystallization properties of the protein, but so far, there is no report of such alternative substitutions being used to efficiently engineer crystallization of an otherwise crystallization-resistant protein.

Recent large-scale experimental studies have shown that the surface properties of proteins, and particularly the entropy of the exposed side chains, are a major determinant of protein crystallization propensity (Slabinski, et al., *Protein Sci* 2007, 16 (11), 2472-82). These studies demonstrated that overall thermodynamic stability is not a major determinant of protein crystallization propensity. They also identified a number of primary sequence properties that correlate with crystallization success, including the fractional content of several individual amino acids. Unfortunately, further studies have demonstrated that every individual amino acid that positively correlates with crystallization success negatively correlates with protein solubility, and vice versa. This effect severely limits the efficacy of using single amino acid substitutions to engineer improved protein crystallization because crystallization probability is low unless starting with a monodisperse soluble protein preparation. Moreover, hydrodynamic heterogeneity and aggregation, which are correlated with low solubility, significantly impede crystallization (Slabinski, et al., *Protein Sci* 2007, 16 (11), 2472-82; Edsall, *Journal of the history of biology* 1972, 5 (2), 205-57). Therefore, any engineering strategy focused on single-residue substitutions is likely to suffer from problems with protein solubility, as has been observed for the Surface Entropy Reduction method (Stanley, *Science* (New York, N.Y. 1935, 81 (2113), 644-645; Lessin, *J Exp Med* 1969, 130 (3), 443-66; Ferre-D'Amare, Structure 1994, 2 (5), 357-9). More complex approaches than single amino-acid substitutions are needed for efficient engineering of improved protein crystallization.

Described herein is an analysis of crystal-packing interactions in the Protein Data Bank based on a new analytical framework specifically developed to support rational engineering of improved protein crystallization. Also described herein are results demonstrating such approaches based on introduction of more complex sequence epitopes that have already been observed to mediate high-quality packing contacts in crystal structures deposited into the Protein Data Bank (PDB). Many naturally occurring proteins have excellent solubility properties and also crystallize very well. The results described herein show that specific protein surface epitopes can mediate strong interprotein interactions under the special solution conditions that drive protein crystallization without compromising solubility in the dilute aqueous buffers used for protein purification.

Beyond providing a library of previously observed linear crystal-packing epitopes, this analysis provides new insight into the physiochemical properties of protein crystals. Packing interactions typically involve approximately half of all residues on the protein surface, and are extremely polymorphic among proteins with very high homology, even those with nearly identical cell unit cell constants. However, there are indications that some sequences can preferentially mediate high-quality packing interactions. Furthermore, most isolated packing epitopes are small in size and extent, suggesting that they may be feasible targets for engineering efforts.

Example 4—Identification and Analysis of Sequence Epitopes Mediating Interprotein Packing Interactions in the PDB Described herein is a hierarchical analytical scheme to identify contiguous epitopes potentially useful for protein engineering (FIG. 3). This scheme is used to analyze all interprotein packing interactions in crystal structures in the PDB (FIG. 5). The hierarchical scheme is at the heart of our analysis. As used herein, an interface refers to all residues making atomic contacts (≤4 Å) between two protein molecules related by a single rotation-translation operation in the real-space crystal lattice. The interface is decomposed into features that we call Elementary Binary Interaction Epitopes (EBIEs—top of FIG. 3). These comprise a connected set of residues that are covalently bonded or make van der Waals interactions to one other in one molecule and that also contact a similarly connected set of residues in the other molecule forming the interface. EBIEs are the foundation of the analysis described herein because they represent potentially engineerable sequence motifs. One or more EBIEs that are connected to one another by covalent bonds or van der Waals interactions within a molecule form a Continuous Binary Interaction Epitope (CBIE). One or more CBIEs in one molecule that are connected to one another indirectly by a chain of contacts across a single interface form a Full Binary Interaction Epitope (FBIE). The set of one or more FBIEs that all mediate contacts between the same two molecules in the real-space lattice form a complete interface (bottom of FIG. 3).

The results of applying this analytical scheme to the entire PDB are shown in FIG. 5. On average, approximately half of all surface-exposed residues participate in crystal packing interactions (FIG. 5B). Protein chains form a plurality of interfaces each, with many more non-proper interfaces than proper interfaces formed (FIG. 5C). The set of proper interfaces, which are more likely to be oligomers or biological interfaces, contains many more larger interfaces than nonproper interfaces (FIG. 5D). However, while these data describe the composition of the crystal structures in the PDB as a whole, they do not address complications raised by nonhomogoneities within the population of the PDB. In particular, two issues need to be addressed. First, FIG. 5B-D shows that proper interfaces behave significantly differently from nonproper interfaces, indicating that they should be segregated for analysis. Second, the PDB contains many structures which are partially or completely redundant, which creates small inaccuracies in the characterization of structures in general but much larger problems in the eventual identification of sequence motifs which are overrepresented in crystal packing interactions. As described herein, both of these concerns are addressed by computational flagging and downweighting mechanisms.

The BioMT database, which categorizes all previously described biological interfaces in the PDB, was used to identify biological oligomers. Interfaces so identified were flagged as "BioMT" interfaces. Recognizing that some potential oligomeric interfaces may not be appropriately categorized by BioMT, the set of "proper" interfaces which could be either biological or crystallographic were also identified.

Interfaces were designated as "proper" if they form part of a regular oligomer with proper rotational symmetry (i.e., n protein molecules in the realspace lattice each related to the next by a 360°/n rotation±5°, with n being any integer from 2-12) and "non-proper" if they do not. Proper interfaces could potentially be part of a stable physiological oligomer while non-proper interfaces cannot. After these two categorization steps, four sets of interfaces exist: the set of all interfaces; the set of biological interfaces identified by BioMT; the set of proper interfaces not identified as biological interfaces by BioMT, but which could potentially be either biological or crystallographic; and the set of interfaces which are not identified by BioMT and which are not proper, as defined above. The most conservative approach to isolating non-physiological crystal packing interactions is to focus exclusively on non-proper interfaces in order to exclude any complex that is potentially a physiological oligomer. Nonetheless, epitopes that contribute to stabilizing physiological oligomers may still be useful for engineering purposes, and epitopes that promote formation of a regular oligomer would be particularly useful because stable oligomerization strongly promotes crystallization (Slabinski, *Protein Sci* 2007, 16 (11), 2472-82).

Even when all biological and oligomeric interfaces have been removed from the dataset, significant redundancy remains within the PDB. Many proteins in the PDB have had multiple crystal structures deposited, which may have very similar if not identical packing interactions (e.g., multiple mutations at a non-interacting active site) but which can also have completely separate packing interactions (e.g., crystallization under different conditions into a different crystal form). Simply culling identical or homologous proteins would remove all redundancy but would also eliminate significant information from the second situation, where the same protein forms crystals with different packing interactions. To implement a redundancy down-weighting, the Packing Similarity Score (PSS) was developed to evaluate the similarity between interprotein interfaces, full chain interactions, and crystals. PSS is calculated in the following way (more details are included in Methods): Interactions matrices are generated for each interface, with rows representing residues in one chain and columns representing residues in the other chain. Cells in the matrix include the number of interatomic contacts between the two residues (including bonds mediated by a single solvent molecule) and the B-factor-derived weight associated with that contact. The PSS between two interfaces is defined as the Frobenius product (essentially a matrix dot-product) of the two sequence-aligned interaction matrices, normalized to a range between 0 and 1. This value contains significant information about the overall similarity of two interfaces, and is sensitive to small changes; it also necessarily encodes the more basic information about the fraction of preserved residues (FIG. 4A). To calculate the PSS for two chains or two crystals, the process is essentially repeated on a larger scale. Each interface in one chain is matched with an interface in the second chain with which it has the highest PSS. Interfaces are ordered in this way, and the individual interaction matrices are then inscribed into the larger chain/chain or crystal/crystal interaction matrix. The Frobenius product of this matrix is then taken. However, since best-matches are not necessarily reciprocal, the best-interface-matching process is repeated in reverse to ensure reciprocality of the chain or crystal PSS. The Frobenius products of the two matrices are added and then normalized to give the chain or crystal PSS.

FIG. 4 shows statistics from application of this analytical scheme to all crystal structures in the PDB (39,208 entries). The average number of total, proper, and non-proper interfaces per protein molecular are 6.9, 1.8, and 5.1, respectively (FIG. 5A). While a minimum of four interfaces are required for a single molecule to form a 3-dimensional lattice, fewer are possible when multiple molecules are present in the crystallographic asymmetric unit. Proteins generally contain only a small number of interfaces beyond the minimum required for lattice formation, indicating that most interfaces contribute to structural stabilization of the lattice. On average, 50% of surface-exposed residues and 36% of all residues participate in interprotein packing interactions (FIG. 5B). While interfaces range widely in size, 36% of all interfaces and 42% of non-proper interfaces contain 10 or fewer residues counting contributions from both sides of the interface (~5 from each participating molecule) (FIG. 5C). The small size of the average interface is encouraging relative to the feasibility of engineering interface formation. Half of all interfaces are under eight residues in size, and a quarter (8678 total) are under eight residues in range within the polypeptide chain (separation). The cumulative size/range distributions for all interfaces, CBIEs, and EBIEs (FIG. 5D) shows that most interfaces are topologically simple and local in the primary sequence, even though some are complex. It is noteworthy that FBIE's contain on average fewer than two EBIEs (not shown) and that most EBIEs are less than 4 residues in size and 10 residues in range. These small EBIEs represent prime candidates for engineering improved crystallization of crystallization-resistant proteins.

Quantifying similarity in the crystal-packing interactions of homologous proteins demonstrates pervasive polymorphism in interprotein interfaces. A general method was developed to quantify the similarity between different interprotein packing interfaces formed by homologous proteins. Its foundation is a B-factor-weighted count ($C_{ij}$) of interatomic contacts between residues i and j across the interface:

$$C_{ij} = \sum_{atom.pairs} \left( \frac{\langle B \rangle_{2-10\%}}{\sqrt{B_m B_n}} \right)^n$$

The terms $B_m$ and $B_n$ are the atomic B-factors of the contacting atoms in residues i and j, respectively (i.e., atoms with centers separated by less than 4 Å), while $\langle B \rangle_{2-10}\%$ represents an estimate of the B-factor of the most ordered atoms in the structure (which is calculated as the average B-factor of atoms in the 2nd through $10^{th}$ percentiles). An upper bound of 1.0 is imposed on the B-factor ratio (i.e., it is set to 1.0 whenever $(B_m B_n)^{1/2} << \langle B \rangle_{2-10}\%$). The exponent n is an adjustable parameter in our software that allows analyses to be performed either without (n=0) or with (n≥1) down-weighting of contacts between atoms with high B-factors. Such atoms, which have enhanced disorder, may contribute less to interface stabilization, but prior literature on this topic is lacking. Therefore, we developed an analytical approach facilitating exploration of B-factor effects. Specifically, using higher values of n in our scoring function progressively down-weights high B-factor contacts.

Each interface in a crystal structure (as defined above) is quantitatively described by a contact matrix C containing the corresponding $C_{ij}$ values (i.e., with its rows and columns indexed by the residue numbers in the two interaction proteins). To evaluate the similarity in interprotein interfaces formed by homologous proteins, their sequences are aligned using the program CLUSTAL-W (Mateja, *Acta crystallographica* 2002, 58 (Pt 12), 1983-91) (after transitively grouping together all proteins sharing at least 60% sequence identity). This procedure effectively aligns both the columns and rows in the contact matrices for interfaces formed by the homologous proteins. The Packing Similarity Score (PSS) between the interfaces is then calculated as the Frobenius (matrix-direct) product between the respective contact matrices. This procedure is mathematically equivalent to calculating a dot-product between vectors filled with the contact count between residue pairs in the interfaces. PSSs value ranges from 1.0, if the number of contacts between each interfacial residue pair is identical, to 0.0, if no pairwise contacts are preserved.

This metric was used to analyze a dataset comprising all pairs of crystal structures in the PDB containing proteins with ≥98% sequence identity (FIG. 4C). This dataset includes a heterogeneous mixture of mutant/ligand-bound structures in the same spacegroup as well as alternative crystal forms of the same protein. While many interfaces are approximately conserved, it is rare for identical packing interactions to be observed in different crystal structures of nearly identical proteins. While 35% of interfaces show PSSs of 0.80-0.95, another 30% have PSSs from 0.40-0.80. Therefore, there is almost invariably some degree of plasticity in interfacial packing contacts and frequently substantial polymorphism. Importantly, the residues involved in crystal-packing interactions tend to be conserved (~50% over random expectation) even when pairwise interactions in the interface are not conserved. This observation indicates that some surface residues have inherently high crystallization-packing potential, so introducing corresponding epitopes into a protein is likely to increase its crystallization propensity even if the complementary epitope is not present.

The observation that some interfacial contacts are preserved, while other are not, leads to a series of important conceptual and practical conclusions. Most importantly, conservation of packing similarity provides experimental data on the strength of the different packing contacts within an interface, because energetically more stable contacts are less likely to be perturbed to satisfy differences in the physiochemical environment in different crystals. The results and molecular-mechanics calculations described herein show that the more preserved packing contacts have higher thermodynamic stability than the less preserved contacts. These contacts with higher stability are likely to play an important role in specifying and stabilizing the crystal lattice, and are therefore prioritized for evaluation in epitope-engineering experiments. Some residues contribute more than others to stabilization of crystal packing-interactions in thermodynamic dissection of interprotein interfaces in stable complexes (Jaroszewski, *Structure* 2008, 16 (11), 1659-67). Residues making packing contacts with lower stability nonetheless need to be immobilized upon interface formation, which will incur a substantial entropic penalty that could be larger than their favorable contribution to the formation of crystal interfaces. In this context, it is not surprising that crystallization is thermodynamically finicky and very sensitive to the mean entropy of surface-exposed side chains (Derewenda, *Acta crystallographica* 2006, 62 (Pt 1), 116-24).

Mutation of surface-exposed residues is likely to induce changes in crystal packing whether they participate in either high-stability or low stability contacts. This effect, combined with the fact that 60% of the surface-exposed residues in the average protein make interfacial contacts (FIG. 5A), rationalizes the fact that surface mutations very frequently change crystallization behavior and that proteins with less than 90% sequence identity only form similar non-proper packing interfaces very infrequently (FIG. 5C). However, engineering improved crystallization behavior requires introduction of epitopes with a propensity to form high-stability crystal-packing contacts.

Creation of a library of all linear sequence epitopes mediating crystal-packing interactions in the PDB and to develop metrics to score their packing potential. We have created a database containing a library of all EBIEs, CBIEs, and FBIEs in the PDB that span at most two successive regular secondary structural elements and flanking loops (as identified by the DSSP algorithm (Wukovitz, *Nat Struct Biol.* 1995, 2 (12), 1062-7)). The sequence of both contacting and non-contacting residues is stored along with the standard DSSP-encoding of the secondary structure at each position in the protein structure in which the epitope was observed to mediate a crystal packing interaction. All metrics possibly related to the crystal-packing potential of the epitope are recorded, including B-factor distribution parameters, statistical enrichment scores relative to all interfaces in the PDB as well as conservation in multiple crystals from homologous proteins, and crystallization propensity and solubility scores based on the sequence composition of the epitope. The database includes the identity of all EBIE pairs making contact with each other as well as a breakdown of the composition of all FBIEs and CBIEs in terms of their constituent EBIES.

Computational analyses of crystal-packing interactions in the PDB to identify short epitopes with statistically enhanced occurrence in crystal-packing interfaces. This library is used to count all EBIEs which appear in the PDB, and to determine which sequences are statistically overrepresented in EBIE's given their background frequency in non-interacting sequences in the PDB.

Prior to considering specific amino acid sequences, the secondary structure patterns which appeared most frequently in EBIEs were examined. Some secondary structure patterns appeared much more frequently than others; these are summarized in Table 2.

Example 6—Epitope-Engineering Experiment

Figure 15:
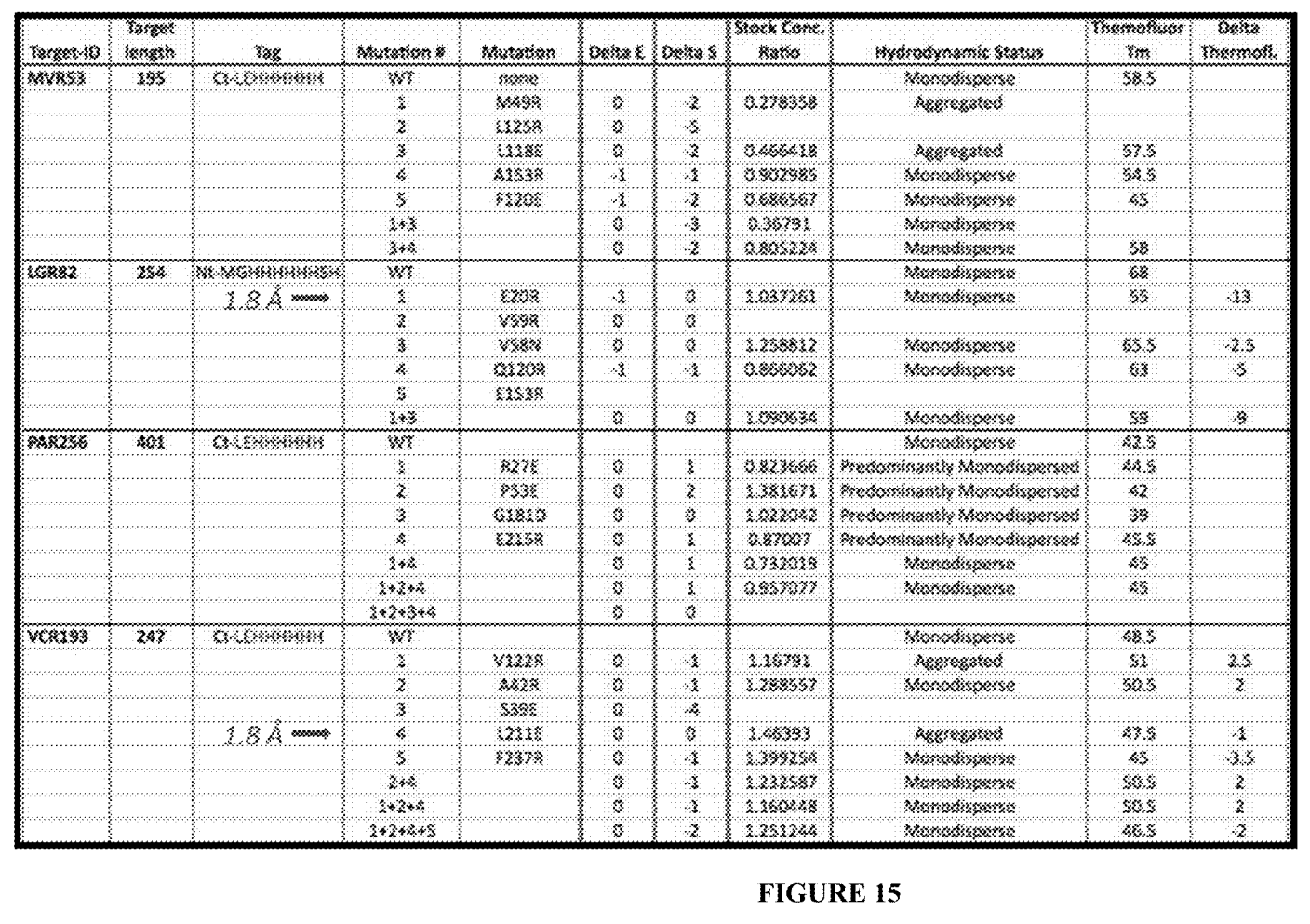
Figure 16:
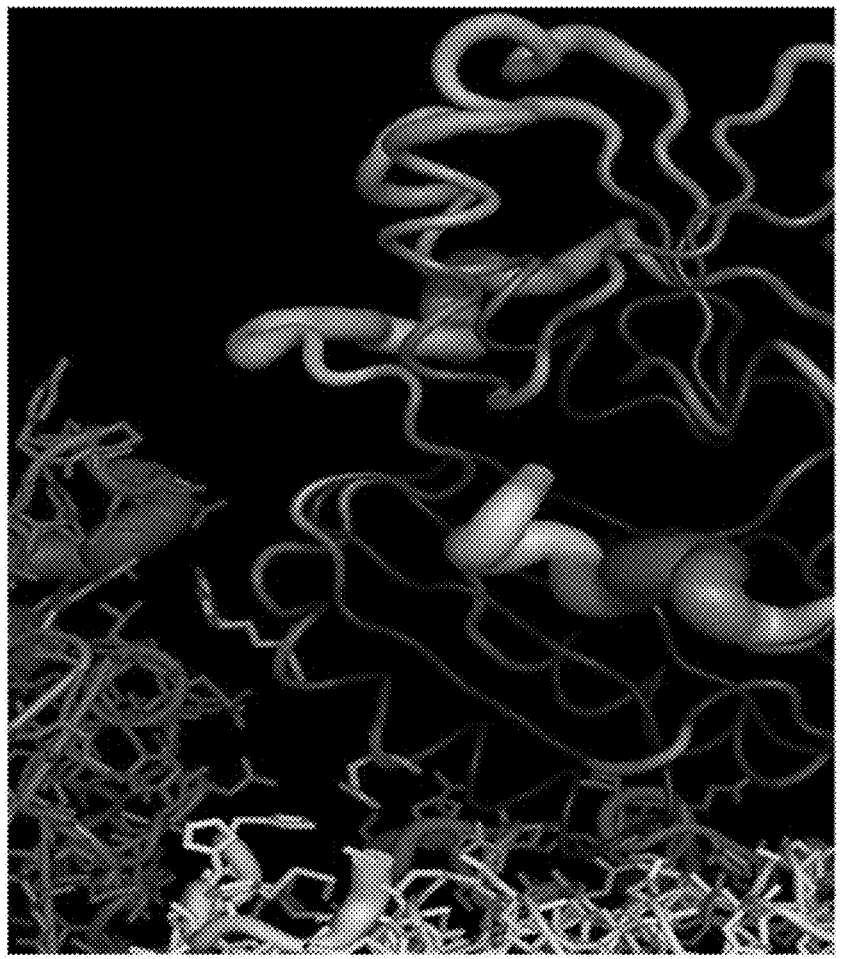
FIG. 16 shows the structure of epitope-engineered protein LpYceA (LgR82). The eptitope mutation that produced this structure participates directly in a crystal-packing interaction.

The methods described herein were used to select putative crystallization-enhancing epitopes for six target proteins that yielded unsolvable crystals and another three that never yielded crystals of any kind with their native sequences (FIG. 9 & FIG. 10). After making an average of three epitope mutations per protein, crystal structures were obtained for five of the six proteins that yielded unsolvable crystals with their native sequences (FIG. 9). Furthermore, crystals for two of the four proteins that failed to yield any crystals with their native sequences were also obtained. Both 1.9 Å and 1.8 Å diffraction was obtained for these two proteins respectively, and both datasets led to solved crystal structures (FIGS. 15-16). All of the amino-acid substitutions that produced crystal structures involved substitution of a residue with higher sidechain entropy than the residue it replaced in the native sequence. In three cases, the successful mutation involved introduction of lys or glu residues, exactly the residues that are removed in classic surface-entropy reduction. Therefore, while engineering low surface entropy is one consideration underlying the methods described herein, the design strategy focusing on tertiary epitopes leads to fundamentally different kinds of amino acid substitutions than used in previous surface-entropy reduction methods involving substitution of individual amino acids with low sidechain entropy, which are generally more hydrophobic and impair protein solubility. In contrast, in the results described herein, 39 of 41 mutant proteins (95%) were sufficiently stable and soluble to undergo high-throughput crystallization screening (FIGS. 10 A and B). Only two of these were significantly destabilized compared to the native sequence based on Thermofluor analyses (FIG. 10C). The vast majority produced a significant increase in the number of crystallization hits in systematic high-throughput screening (FIG. 10D). One crystal structure was obtained from a mutant that reduced the total number of hits but produced hits under alternative chemical conditions. This property was shared by 28 of 32 screened mutant proteins, i.e., they yielded at least some and typically many "hits" under alternative conditions than the WT protein (FIG. 10E). Two of the five crystal structures generated from mutant proteins show the mutated residue making a direct contact in a packing interface (e.g., FIG. 10F), although with somewhat different stereochemistry from the template used for engineering. The third structure shows the mutant residue contacting an adjacent residue that makes a crystal packing contact. However, the fourth structure shows the mutant residue in a region of weak electron density, while the fifth shows it to be relatively remote from any packing interface.

An advantage of the methods described herein is its very high yield of soluble protein variants, which enable the search for chemical conditions mediating stable lattice formation to be conducted with proteins with a greater diversity of surface properties that are generally favorable for crystallization. This new crystallization-screening "variable", which can be explored efficiently with the methods describes herein, enables more effective exploitation of the thermodynamic forces promoting crystallization during extensive chemical screening.

Example 7—Epitope Sub-Distributions

B-factor distributions in sub-epitopes can also be evaluated as a function of overrepresentation ratio, structure resolution, residue type, epitope size, buried surface area, and proportional contribution to an interface in connection with the methods described herein. Such analysis can be used to design of ranking metrics using sub-epitope B-factor distributions.

Analyses of topological, energetic, and primary sequence differences between non-BIOMT/non-proper crystal packing interactions and BIOMT interfaces mediating stable protein oligomerization, can also be used in connection with the methods described herein. Such analyses can be used to determine whether ranking metrics excluding BIOMT interfaces improve outcome.

Several reference databases can be generated in addition to the 1-to-6-mer sub-epitope database described herein (EEDb1). One such reference database can be used to restrict overrepresentation calculations and engineering suggestions to sub-epitopes with surface-exposed residues at all contacting positions (EEDb2). Other reference databases can be used to restrict consideration to complete EBIEs rather than including sub-epitopes (EEDb3). Yet another reference database could be limited to single amino acids in a specific secondary structure as presented in FIG. 18.

The epitope-engineering methods described herein can be adapted for alpha-helical integral membrane proteins (IMPs). This adaptation can be performed by adding a second mask to the specification of each epitope indicating whether it resides in a transmembrane alpha-helix. The epitope distributions observed in the crystal structures of alpha-helical IMPs can be compared to those in the full PDB and the distribution of packing contacts relative to the centroids and the termini of the transmembrane α-helices can be analyzed. The observed patterns can be used to customize epitope-engineering suggestions for α-helical IMPs.

Example 8—Introduction of Salt Bridges Improve Crystallization

One of the most overrepresented dimeric crystallization sub-epitopes in the PDB comprises a glu-arg salt-bridge on the surface of an α-helix (ExxxR (SEQ ID NO: 50)/HHHHH in Table 37). Introduction of this sub-epitope into predicted alpha-helices in crystallization-resistant proteins can improve their crystallization sufficiently to yield a structure.

Four NESG proteins that have given crystals with at best poor diffraction (4-8 Å limiting resolution at the synchrotron) and another four that have never given a crystallization hit were selected for analysis. These eight proteins were mutated to introduce new glu-arg salt-bridges at 4 different sites in predicted alpha-helices. The mutant proteins were expressed and analyzed for their solubility, stability, and hydrodynamic homogeneity and subjected to crystallization screening and optimization using the standard NESG platform. All related experimental data were systematically evaluated to determine whether any of the sequence parameters and computational metrics correlated with outcome at every stage of the pipeline (i.e., expression, solubility, stability, and crystal-structure solution.)

Example 9—Introduction of Other Epitopes Improve Crystallization

Similarly designed studies will be conducted on four other highly overrepresented dimeric sub-epitopes shown in Table 37. Another study will focus on introducing 20 different candidate sub-epitopes into each of two poorly crystallizing proteins to evaluate correlations between protein expression/crystallization outcome and all computed ranking metrics. Another study will take a similar approach to determining whether efficacy is improved by limiting engineering to complete EBIEs rather than using sub-epitopes. Based on the results obtained from these initial studies, additional studies will be designed to further explore the efficacy of alternative crystallization-epitope-engineering strategies.

Example 10—Effects of Epitope Engineered Single and Poly Mutant Proteins on Protein Solubility The introduction of crystallization-inducing epitopes can also have effects on other protein characteristics, such as solubility. To compare the solubility of the wildtype protein VCR193 to its epitope mutants, each VCR193 construct was subjected to a precipitant solution of ammonium sulfate at varying concentrations, and after a period of incubation, soluble protein levels tested with a NanoDrop 200 UV-Vis Spectrophotometer.

All protein stock concentrations were determined using the NanoDrop 2000 at A280. A stock solution of precipitant (3M NH4SO4) was prepared in Experimental buffer (50 mM sodium acetate, pH 4.25). Using these stock concentration values, mixtures of varying protein and precipitant concentrations were prepared in 1.5 mL Eppendorf tubes at room temperature. For each construct, final protein concentrations of 1, 2 and 4 mg/mL were mixed with final precipitant concentrations of 0.8, 1.0, 1.2 and 1.4M NH4SO4. Experimental buffer was used to bring each aliquot to a final volume of 50 uL. For all samples, components were introduced in the order of precipitant, buffer, and protein. All samples were performed in duplicate. Once all mixtures were prepared, samples were incubated at room temperature for 5 minutes, then transferred to a benchtop microcentrifuge. Samples were spun for 2 minutes at 13.4K RPM to pellet any precipitation. Sample supernatants were then tested for remaining soluble protein with the NanoDrop 2000.

Figure 12:
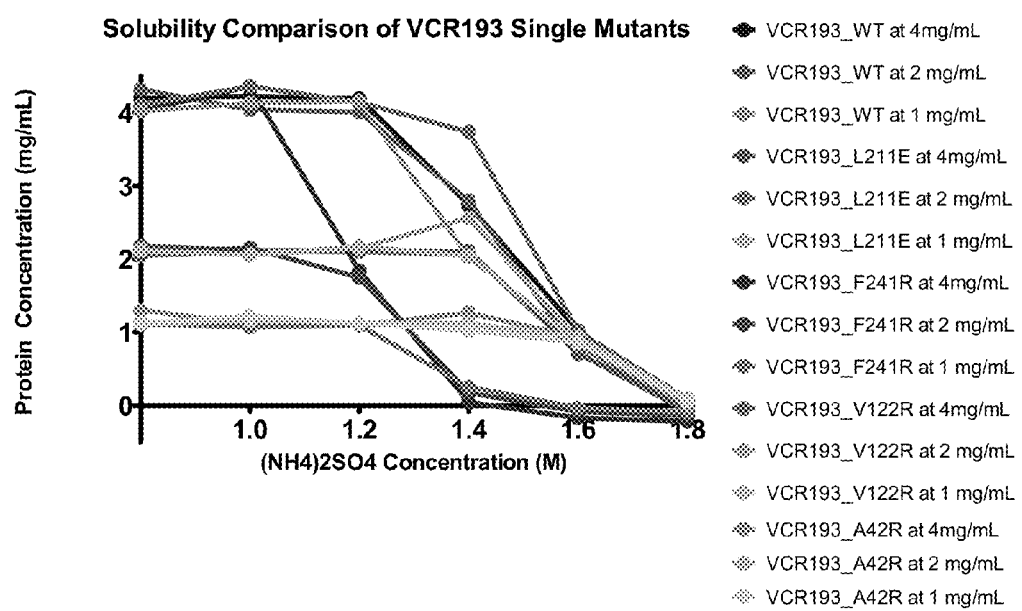
FIG. 12 shows a solubility comparison of VCR193 single mutants.

Results show that for the 4 single mutants designed for VCR193, only one (VCR193_F241R) had a detrimental effect on protein solubility (FIG. 12) Notably, the mutation reducing solubility was the only one among the set tested to significantly destabilize the protein thermodynamically. All other mutants maintained, or showed a slight increase (VCR193_V122R) in protein solubility.

Figure 13:
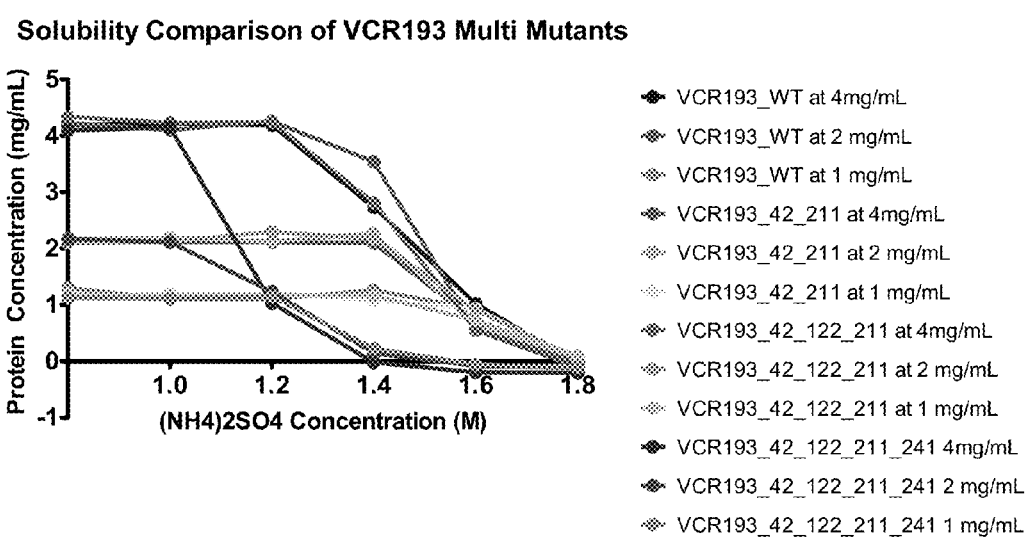
FIG. 13 shows a solubility comparison of VCR193 multi mutants.

Similar results were seen for the poly-mutant samples (FIG. 13). Protein solubility was not affected, except in the one poly mutant that contained the VCR193_F241R mutation which had previously shown a decrease in solubility.

Example 11—Combining Multiple Epitope Mutations can Produce Additional Large Gains in Crystallization Propensity Over the Individual Constituent Mutations Purified proteins were set up in a standard robotic microbatch crystallization screen. The screen covered 1536 different chemical conditions. Observations were reported after one week of incubation at 4° C., based on robotic imaging of the reactions and manual evaluation of the resulting optical micrographs. The results in FIG. 14 demonstrate that the epitope mutations in this protein generally increase the number of crystallization hits and always yield hits under different crystallization conditions than the WT protein. Combining multiple epitope mutations increases further the number of hits obtained, indicating that this "multimutant" crystallizes more avidly than the individual epitope mutant.

Example 12—Epitope-Engineering Study on "No Hits" Proteins

Proteins were selected with Pxs≥0.25, monodisperse stocks, and clean Thermofluor melts. Four proteins that showed no evidence of crystallization with their native sequences in the 1536 well screen were re-purified and put through the 1536 well screen a second time, to verify their failure to crystallize prior to the generation of mutants. Four or five epitope mutations, primarily introducing salt-bridges, were then introduced into each protein, and the resulting mutant variants were purified and analyzed, yielding results summarized in FIG. 15. Of the 18 mutations for which data are presented, 16 essentially preserved the stability and solubility of the protein. Single epitope mutations yielded very high quality crystal structures for two of the four proteins in the study. The results show that epitope mutations producing crystal structures are located in packing contacts. The mutated residues make direct or water-mediated hydrogen-bonds in one of the crystal-packing interfaces in these structures, as shown for protein LpYceA (LgR82) in FIG. 16 on the right. Any failures were either large (>400 aa) or yielded aggregation-prone proteins upon mutation. Additional epitope mutations can be introduced into stable di- and tri-mutants of failures.

Figure 18:
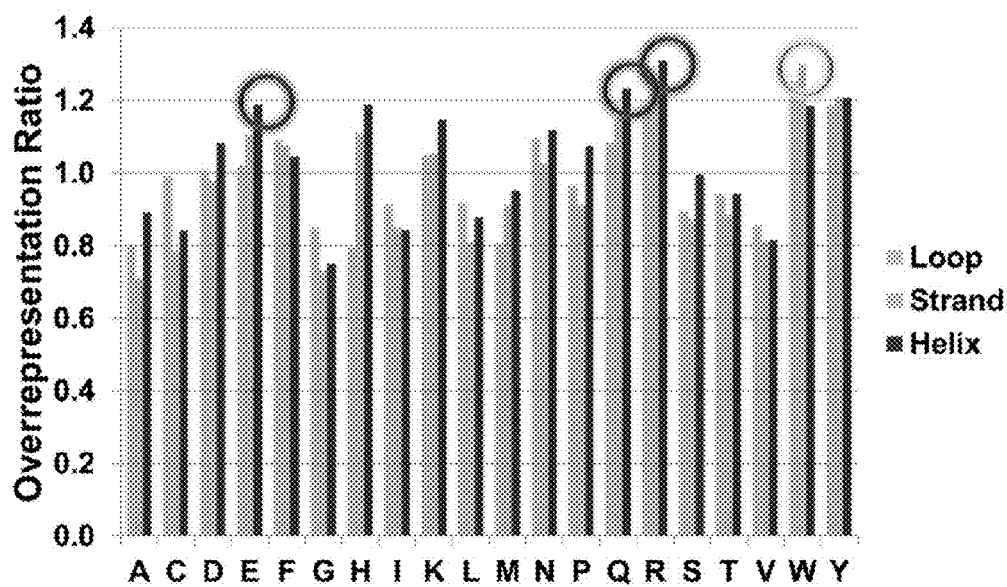
FIG. 18 shows that Arg in alpha-helices is the most strongly overrepresented amino-acid/secondary-structure class in interfaces in the PDB.
Figure 19:
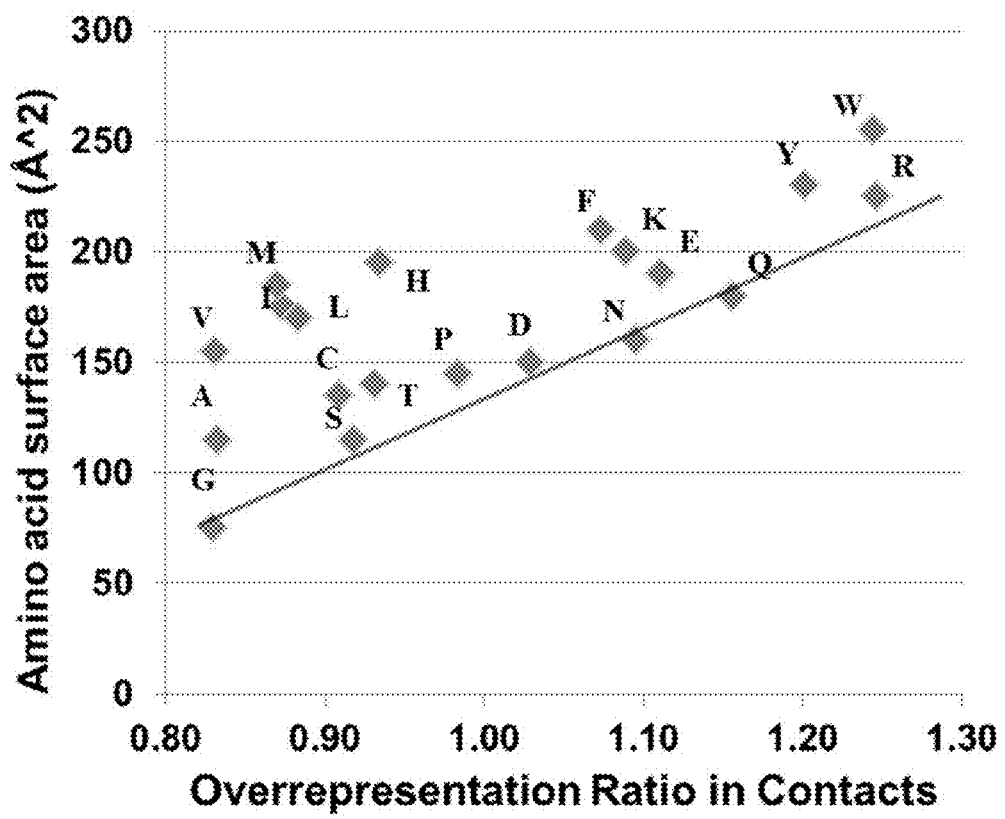
FIG. 19 shows polar amino acids predominate those most strongly overrepresented in interfaces after area-normalization.

Example 13—Overrepresentation of Individual Amino Acids in Specific Secondary Structures in Packing Interfaces in the PDB After normalization for the abundance of the amino acids on protein surfaces in the PDB ("surface-shaping"), the number of amino acids in each secondary-structure class making crystal-packing interactions was counted and compared to random expectation. FIG. 18 shows the overrepresentation ratios calculated in this manner for the 60 classes (20 amino acids in three possible secondary structures—H, E, and L for helix, strand, and "loop", respectively). FIG. 19 presents the same values plotted against the solvent-accessible surface area of the sidechain of each amino acid, which shows that amino acids with comparable surface area have significantly different propensity to mediate crystal-packing interactions. Notably, many of the most strongly overrepresented residues in crystal-packing interfaces have a negative influence (e.g., gln, glu, or lys in helices) or a neutral influence (arg in helices) on crystallization propensity when overall amino-acid-frequency on the protein surface is analyzed. Therefore, the data presented in these slides demonstrate that the structural context of individual amino acids has a critical effect on their propensity to mediate crystal-packing interactions. These results demonstrate that the epitope library described herein is successful in identifying the proper context, as evidenced by the data obtained in experiments introducing these epitopes into crystallization-resistant proteins. This context frequently involves high-entropy polar side chains being constrained by local entropy-reducing structural interactions. Notably, the amino acids substitutions that have been most successful in yielding crystal structures in these experiments (i.e., glu and arg in helices) are among the most strongly overrepresented in crystal-packing interfaces once secondary structure is taken into account, as shown in FIG. 18. Therefore, one reason that our methods are successful in improving protein crystallization is that they guide insertion at productive locations of amino acids that have a high propensity to mediate crystal-packing interactions when present in the right structural context.

REFERENCES

1. Kendrew, J. C.; Bodo, G.; Dintzis, H. M.; Parrish, R. G.; Wyckoff, H.; Phillips, D. C., A three-dimensional model of the myoglobin molecule obtained by x-ray analysis. Nature 1958, 181 (4610), 662-6.
2. Canaves, J. M.; Page, R.; Wilson, I. A.; Stevens, R. C., Protein biophysical properties that correlate with crystallization success in *Thermotoga maritima*: maximum clustering strategy for structural genomics. Journal of molecular biology 2004, 344 (4), 977-91.
3. Slabinski, L.; Jaroszewski, L.; Rodrigues, A. P.; Rychlewski, L.; Wilson, I. A.; Lesley, S. A.; Godzik, A., The challenge of protein structure determination—lessons from structural genomics. Protein Sci 2007, 16 (11), 2472-82.
4. Price, W. N., 2nd; Chen, Y.; Handelman, S. K.; Neely, H.; Manor, P.; Karlin, R.; Nair, R.; Liu, J.; Baran, M.; Everett, J.; Tong, S. N.; Forouhar, F.; Swaminathan, S. S.; Acton, T.; Xiao, R.; Luft, J. R.; Lauricella, A.; DeTitta, G. T.; Rost, B.; Montelione, G. T.; Hunt, J. F., Understanding the physical properties that control protein crystallization by analysis of large-scale experimental data. Nat Biotechnol 2009, 27 (1), 51-7.
5. Cooper, D. R.; Boczek, T.; Grelewska, K.; Pinkowska, M.; Sikorska, M.; Zawadzki, M.; Derewenda, Z., Protein crystallization by surface entropy reduction: optimization of the SER strategy. Acta crystallographica 2007, 63 (Pt 5), 636-45.

6. Derewenda, Z. S., The use of recombinant methods and molecular engineering in protein crystallization. Methods 2004, 34 (3), 354-63.
7. Derewenda, Z. S.; Vekilov, P. G., Entropy and surface engineering in protein crystallization. Acta crystallographica 2006, 62 (Pt 1), 116-24.
8. Sumner, J. B., The Isolation and Crystallization of the Enyzme Urease. J Biol Chem 1926, 69, 435-441.
9. Stanley, W. M., Isolation of a Crystalline Protein Possessing the Properties of Tobacco-Mosaic Virus. Science (New York, N.Y. 1935, 81 (2113), 644-645.
10. Edsall, J. T., Blood and hemoglobin: the evolution of knowledge of functional adaptation in a biochemical system, part I: The adaptation of chemical structure to function in hemoglobin. Journal of the history of biology 1972, 5 (2), 205-57.
11. Hunt, J. A.; Ingram, V. M., Allelomorphism and the chemical differences of the human haemoglobins A, S and C. Nature 1958, 181 (4615), 1062-3.
12. Lessin, L. S.; Jensen, W. N.; Ponder, E., Molecular mechanism of hemolytic anemia in homozygous hemoglobin C disease. Electron microscopic study by the freeze-etching technique. J Exp Med 1969, 130 (3), 443-66.
13. Kendrew, J. C.; Perutz, M. F., A comparative X-ray study of foetal and adult sheep haemoglobins. Proc R Soc Lond A Math Phys Sci 1948, 194 (1038), 375-98.
14. Kendrew, J. C., Structure and function in myoglobin and other proteins. Fed Proc 1959, 18 (2, Part 1), 740-51.
15. Page, R.; Stevens, R. C., Crystallization data mining in structural genomics: using positive and negative results to optimize protein crystallization screens. Methods 2004, 34 (3), 373-89.
16. Cumbaa, C. A.; Lauricella, A.; Fehrman, N.; Veatch, C.; Collins, R.; Luft, J.; DeTitta, G.; Jurisica, I., Automatic classification of sub-microliter protein-crystallization trials in 1536-well plates. Acta crystallographica 2003, 59 (Pt 9), 1619-27.
17. Luft, J. R.; Collins, R. J.; Fehrman, N. A.; Lauricella, A. M.; Veatch, C. K.; DeTitta, G. T., A deliberate approach to screening for initial crystallization conditions of biological macromolecules. Journal of structural biology 2003, 142 (1), 170-9.
18. Ferre-D'Amare, A. R.; Burley, S. K., Use of dynamic light scattering to assess crystallizability of macromolecules and macromolecular assemblies. Structure 1994, 2 (5), 357-9.
19. Spraggon, G.; Pantazatos, D.; Klock, H. E.; Wilson, I. A.; Woods, V. L., Jr.; Lesley, S. A., On the use of DXMS to produce more crystallizable proteins: structures of the T. maritima proteins TM0160 and TM1171. Protein Sci 2004, 13 (12), 3187-99.
20. Longenecker, K. L.; Garrard, S. M.; Sheffield, P. J.; Derewenda, Z. S., Protein crystallization by rational mutagenesis of surface residues: Lys to Ala mutations promote crystallization of RhoGDI. Acta crystallographica 2001, 57 (Pt 5), 679-88.
21. Czepas, J.; Devedjiev, Y.; Krowarsch, D.; Derewenda, U.; Otlewski, J.; Derewenda, Z. S., The impact of Lys→Arg surface mutations on the crystallization of the globular domain of RhoGDI. Acta crystallographica 2004, 60 (Pt 2), 275-80.
22. Mateja, A.; Devedjiev, Y.; Krowarsch, D.; Longenecker, K.; Dauter, Z.; Otlewski, J.; Derewenda, Z. S., The impact of Glu→Ala and Glu→Asp mutations on the crystallization properties of RhoGDI: the structure of RhoGDI at 1.3 A resolution. Acta crystallographica 2002, 58 (Pt 12), 1983-91.
23. Jaroszewski, L.; Slabinski, L.; Wooley, J.; Deacon, A. M.; Lesley, S. A.; Wilson, I. A.; Godzik, A., Genome pool strategy for structural coverage of protein families. Structure 2008, 16 (11), 1659-67.
24. Sammut, S. J.; Finn, R. D.; Bateman, A., Pfam 10 years on: 10,000 families and still growing. Briefings in bioinformatics 2008, 9 (3), 210-9.
25. Wukovitz, S. W.; Yeates, T. O., Why protein crystals favour some space-groups over others. Nat Struct Biol 1995, 2 (12), 1062-7.
26. Banatao, D. R.; Cascio, D.; Crowley, C. S.; Fleissner, M. R.; Tienson, H. L.; Yeates, T. O., An approach to crystallizing proteins by synthetic symmetrization. Proc Natl Acad Sci USA 2006, 103 (44), 16230-5.
27. Ward, J. J.; McGuffin, L. J.; Bryson, K.; Buxton, B. F.; Jones, D. T., The DISOPRED server for the prediction of protein disorder. Bioinformatics 2004, 20 (13), 2138-9.
28. Rost, B., PHD: predicting one-dimensional protein structure by profile-based neural networks. Methods in enzymology 1996, 266, 525-39.
29. Rost, B., How to Use Protein 1D Structure Predicted by PROFphd. In The Proteomics Protocols Handbook, Walker, J. E., Ed. Humana Press: Totowa, 2005; pp 875-901.
30. Rost, B.; Yachdav, G.; Liu, J., The PredictProtein server. Nucleic acids research 2004, 32 (Web Server issue), W321-6.
31. Derewenda, Z. S., Rational protein crystallization by mutational surface engineering. Structure 2004, 12 (4), 529-35.
32. Cieslik, M.; Derewenda, Z. S., The role of entropy and polarity in intermolecular contacts in protein crystals. Acta crystallographica 2009, 65 (Pt 5), 500-9.
33. Acton, T. B.; Gunsalus, K. C.; Xiao, R.; Ma, L. C.; Aramini, J.; Baran, M. C.; Chiang, Y. W.; Climent, T.; Cooper, B.; Denissova, N. G.; Douglas, S. M.; Everett, J. K.; Ho, C. K.; Macapagal, D.; Rajan, P. K.; Shastry, R.; Shih, L. Y.; Swapna, G. V.; Wilson, M.; Wu, M.; Gerstein, M.; Inouye, M.; Hunt, J. F.; Montelione, G. T., Robotic cloning and Protein Production Platform of the Northeast Structural Genomics Consortium. Methods in enzymology 2005, 394, 210-43.
34. Krissinel, E., Crystal contacts as nature's docking solutions. J Comput Chem 31 (1), 133-43.
35. Krissinel, E.; Henrick, K., Inference of macromolecular assemblies from crystalline state. J Mol Biol 2007, 372 (3), 774-97.
36. Xu, Q.; Canutescu, A. A.; Wang, G.; Shapovalov, M.; Obradovic, Z.; Dunbrack, R. L., Jr., Statistical analysis of interface similarity in crystals of homologous proteins. J Mol Biol 2008, 381 (2), 487-507.
37. Higgins, D. G.; Thompson, J. D.; Gibson, T. J., Using CLUSTAL for multiple sequence alignments. Methods in enzymology 1996, 266, 383-402.
38. Cunningham, B. C.; Wells, J. A., High-resolution epitope mapping of hGH-receptor interactions by alanine-scanning mutagenesis. Science (New York, N.Y. 1989, 244 (4908), 1081-5.
39. Kabsch, W.; Sander, C., Dictionary of protein secondary structure: pattern recognition of hydrogen-bonded and geometrical features. Biopolymers 1983, 22 (12), 2577-637.

40. Ding, F.; Dokholyan, N. V., Emergence of protein fold families through rational design. PLoS Comp. Biol. 2006, 2, e85.
41. Yin, S.; Ding, F.; Dokholyan, N. V., Modeling backbone flexibility improves protein stability estimation. Structure 2007, 15, 1567-1576.
42. Gilis, D.; Rooman, M., Predicting protein stability changes upon mutation using database-derived potentials: solvent accessibility determines the importance of local versus non-local interactions along the sequence. Journal of molecular biology 1997, 272 (2), 276-90.
43. Bordner, A. J.; Abagyan, R. A., Large-scale prediction of protein geometry and stability changes for arbitrary single point mutations. Proteins 2004, 57 (2), 400-13.
44. Guerois, R.; Nielsen, J. E.; Serrano, L., Predicting changes in the stability of proteins and protein complexes: a study of more than 1000 mutations. Journal of molecular biology 2002, 320 (2), 369-87.
45. Saraboji, K.; Gromiha, M. M.; Ponnuswamy, M. N., Average assignment method for predicting the stability of protein mutants. Biopolymers 2006, 82 (1), 80-92.
46. Dawson, R. J.; Locher, K. P., Structure of a bacterial multidrug ABC transporter. Nature 2006, 443 (7108), 180-5.
47. Yin, S.; Biedermannova, L.; Vondrasek, J.; Dokholyan, N. V., MedusaScore: An accurate force-field based scoring function for virtual drug screening. J. Chem. Infor. and Model 2008, 48, 1656-1662.
48. Kuhlman, B.; Baker, D., Native protein sequences are close to optimal for their structures. Proc. Natl. Acad. Sci. USA 2000, 97, 10383-10388.
49. Goh, C. S.; Lan, N.; Echols, N.; Douglas, S. M.; Milburn, D.; Bertone, P.; Xiao, R.; Ma, L. C.; Zheng, D.; Wunderlich, Z.; Acton, T.; Montelione, G. T.; Gerstein, M., SPINE 2: a system for collaborative structural proteomics within a federated database framework. Nucleic acids research 2003, 31 (11), 2833-8.
50. Liu, Y.; Eyal, E.; Bahar, I., Analysis of correlated mutations in HIV-1 protease using spectral clustering. Bioinformatics 2008, 24 (10), 1243-50.
51. Eyal, E.; Pietrokovski, S.; Bahar, I., Rapid assessment of correlated amino acids from pair-to-pair (P2P) substitution matrices. Bioinformatics 2007, 23 (14), 1837-9.
52. Hakes, L.; Lovell, S. C.; Oliver, S. G.; Robertson, D. L., Specificity in protein interactions and its relationship with sequence diversity and coevolution. Proceedings of the National Academy of Sciences of the United States of America 2007, 104 (19), 7999-8004.
53. Kann, M. G.; Shoemaker, B. A.; Panchenko, A. R.; Przytycka, T. M., Correlated evolution of interacting proteins: looking behind the mirrortree. J Mol Biol 2009, 385 (1), 91-8.
54. Kann, M. G.; Jothi, R.; Cherukuri, P. F.; Przytycka, T. M., Predicting protein domain interactions from coevolution of conserved regions. Proteins 2007, 67 (4), 811-20.
55. Berman, H. M.; Westbrook, J. D.; Gabanyi, M. J.; Tao, W.; Shah, R.; Kouranov, A.; Schwede, T.; Arnold, K.; Kiefer, F.; Bordoli, L.; Kopp, J.; Podvinec, M.; Adams, P. D.; Carter, L. G.; Minor, W.; Nair, R.; La Baer, J., The protein structure initiative structural genomics knowledgebase. Nucleic acids research 2009, 37 (Database issue), D365-8.

APPENDIX A

TABLE 4

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| R | H | 73875.0 | 56304.4 | 135926.2 | 96.749968 | 0.0000e+00 | 1.00000 | N | 0.543493 | 0.414228 |
| E | H | 102063.2 | 85694.0 | 211404.9 | 72.514212 | 0.0000e+00 | 1.00000 | N | 0.482785 | 0.405355 |
| R | C | 71101.6 | 59909.4 | 138577.7 | 60.689664 | 0.0000e+00 | 1.00000 | N | 0.513081 | 0.432316 |
| Q | H | 48815.1 | 39519.7 | 106533.5 | 58.954888 | 0.0000e+00 | 1.00000 | N | 0.458214 | 0.370961 |
| K | H | 75386.1 | 65574.6 | 154046.4 | 50.558309 | 0.0000e+00 | 1.00000 | N | 0.489373 | 0.425681 |
| R | E | 31731.5 | 25548.4 | 65634.9 | 49.498779 | 0.0000e+00 | 1.00000 | N | 0.483455 | 0.389250 |
| Y | C | 29955.1 | 25200.3 | 79918.7 | 36.198231 | 3.7253e-287 | 1.00000 | N | 0.374820 | 0.315324 |
| Y | H | 22863.8 | 18907.6 | 77770.4 | 33.070975 | 4.4619e-240 | 1.00000 | N | 0.293991 | 0.243121 |
| N | C | 74926.0 | 68249.9 | 172909.9 | 32.846465 | 6.9358e-237 | 1.00000 | N | 0.433324 | 0.394714 |
| Y | E | 20348.1 | 16817.5 | 77792.9 | 30.751543 | 6.6667e-208 | 1.00000 | N | 0.261568 | 0.216182 |
| H | H | 17545.3 | 14723.1 | 46812.1 | 28.092472 | 6.9628e-174 | 1.00000 | N | 0.374803 | 0.314515 |
| W | C | 9843.2 | 7836.3 | 28898.7 | 26.555390 | 1.3266e-155 | 1.00000 | N | 0.340610 | 0.271165 |
| W | E | 7175.4 | 5519.1 | 28478.8 | 24.830813 | 2.5110e-136 | 1.00000 | N | 0.251956 | 0.193796 |
| N | H | 29380.1 | 26250.3 | 74966.1 | 23.963336 | 3.6776e-127 | 1.00000 | N | 0.391912 | 0.350162 |
| Q | C | 46688.9 | 43067.7 | 104526.3 | 22.756429 | 6.6571e-115 | 1.00000 | N | 0.446671 | 0.412027 |
| D | H | 48052.3 | 44430.5 | 115744.8 | 22.503742 | 2.0419e-112 | 1.00000 | N | 0.415157 | 0.383002 |
| Q | E | 16054.3 | 13925.4 | 44387.5 | 21.776876 | 2.1490e-105 | 1.00000 | N | 0.361685 | 0.313724 |
| E | E | 27514.1 | 24818.0 | 68285.5 | 21.450513 | 2.4598e-102 | 1.00000 | N | 0.402927 | 0.363444 |
| K | C | 84342.9 | 80316.9 | 179173.6 | 19.124939 | 8.1926e-82 | 1.00000 | N | 0.470733 | 0.448263 |
| W | H | 8266.4 | 6969.2 | 34240.4 | 17.410753 | 3.8441e-68 | 1.00000 | N | 0.241422 | 0.203539 |
| F | C | 25086.1 | 22981.3 | 88412.8 | 16.139207 | 7.1968e-59 | 1.00000 | N | 0.283738 | 0.259932 |
| P | H | 20437.9 | 18997.4 | 55888.0 | 12.864046 | 3.7994e-38 | 1.00000 | N | 0.365694 | 0.339919 |
| K | E | 30928.1 | 29266.2 | 72555.6 | 12.576763 | 1.4865e-36 | 1.00000 | N | 0.426268 | 0.403362 |
| H | E | 9540.2 | 8591.3 | 33198.0 | 11.890730 | 7.1273e-33 | 1.00000 | N | 0.287373 | 0.258790 |
| F | E | 14087.0 | 13074.4 | 85656.9 | 9.620803 | 3.4203e-22 | 1.00000 | N | 0.164458 | 0.152636 |
| E | C | 80396.1 | 78595.3 | 181587.9 | 8.529403 | 7.5074e-18 | 1.00000 | N | 0.442739 | 0.432822 |
| X | H | 360.8 | 254.8 | 654.5 | 8.497762 | 1.3638e-17 | 1.00000 | N | 0.551261 | 0.389301 |
| X | E | 156.4 | 96.6 | 287.5 | 7.471589 | 6.3554e-14 | 1.00000 | N | 0.544000 | 0.335882 |
| X | C | 819.5 | 684.6 | 1607.8 | 6.803125 | 6.0965e-12 | 1.00000 | N | 0.509703 | 0.425809 |
| F | H | 16970.0 | 16250.6 | 93022.4 | 6.212142 | 2.6862e-10 | 1.00000 | N | 0.182429 | 0.174695 |
| D | C | 92573.2 | 91722.3 | 226663.0 | 3.641120 | 1.3686e-04 | 0.99987 | N | 0.408418 | 0.404664 |
| N | E | 12244.9 | 11913.0 | 40730.7 | 3.614854 | 1.5345e-04 | 0.99985 | N | 0.300631 | 0.292483 |
| S | H | 34149.8 | 34223.6 | 112014.7 | -0.476652 | 0.68435 | 0.31796 | N | 0.304869 | 0.305525 |
| C | C | 8790.4 | 8862.7 | 38092.8 | -0.876297 | 0.81121 | 0.19209 | N | 0.230763 | 0.232660 |
| D | E | 13940.8 | 14199.4 | 46856.3 | -2.599200 | 0.99540 | 4.7409e-03 | N | 0.297522 | 0.303041 |

TABLE 4-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| M | H | 11582.9 | 12155.3 | 61070.7 | −5.801564 | 1.00000 | 3.3857e−09 | N | 0.189664 | 0.199037 |
| M | E | 5267.8 | 5774.1 | 33368.7 | −7.327132 | 1.00000 | 1.2408e−13 | N | 0.157867 | 0.173040 |
| P | E | 7858.0 | 8602.7 | 29317.0 | −9.552002 | 1.00000 | 6.7668e−22 | N | 0.268036 | 0.293438 |
| C | H | 3384.9 | 4013.8 | 27016.9 | −10.757787 | 1.00000 | 2.9878e−27 | N | 0.125288 | 0.148566 |
| T | H | 25364.6 | 26858.9 | 95207.8 | −10.761143 | 1.00000 | 2.7304e−27 | N | 0.266413 | 0.282108 |
| P | C | 79479.4 | 82017.5 | 226569.8 | −11.095397 | 1.00000 | 6.7670e−29 | N | 0.350794 | 0.361997 |
| C | E | 3054.0 | 3879.2 | 30999.5 | −14.164659 | 1.00000 | 8.5647e−46 | N | 0.098518 | 0.125137 |
| I | C | 24372.0 | 26598.2 | 100435.4 | −15.920127 | 1.00000 | 2.4323e−57 | N | 0.242663 | 0.264829 |
| T | C | 60897.2 | 64345.5 | 175852.7 | −17.071578 | 1.00000 | 1.2602e−65 | N | 0.346297 | 0.365906 |
| S | E | 18279.6 | 20897.6 | 82683.2 | −20.949793 | 1.00000 | 1.0248e−97 | N | 0.221080 | 0.252742 |
| L | C | 48520.1 | 52756.2 | 185873.9 | −21.792493 | 1.00000 | 1.4458e−105 | N | 0.261038 | 0.283827 |
| T | E | 25710.1 | 29024.2 | 103538.7 | −22.930572 | 1.00000 | 1.2467e−116 | N | 0.248314 | 0.280322 |
| I | E | 18320.0 | 21510.1 | 141124.2 | −23.626283 | 1.00000 | 1.1296e−123 | N | 0.129815 | 0.152420 |
| I | H | 19655.0 | 23276.8 | 135724.2 | −26.080376 | 1.00000 | 3.3441e−150 | N | 0.144816 | 0.171501 |
| L | H | 45000.3 | 51092.6 | 272207.2 | −29.904831 | 1.00000 | 9.1633e−197 | N | 0.165316 | 0.187697 |
| A | H | 52051.2 | 58421.3 | 249208.6 | −30.120751 | 1.00000 | 1.3919e−199 | N | 0.208866 | 0.234427 |
| G | E | 8765.5 | 11960.8 | 69614.7 | −32.104668 | 1.00000 | 2.2298e−226 | N | 0.125914 | 0.171814 |
| L | E | 20637.7 | 25409.3 | 157007.0 | −32.696540 | 1.00000 | 9.7828e−235 | N | 0.131444 | 0.161835 |
| V | H | 21098.2 | 25866.6 | 140167.6 | −32.832062 | 1.00000 | 1.1500e−236 | N | 0.150521 | 0.184540 |
| M | C | 16433.8 | 20329.4 | 60211.0 | −33.571201 | 1.00000 | 2.5524e−247 | N | 0.272937 | 0.337636 |
| V | C | 33470.7 | 39146.4 | 134145.5 | −34.088036 | 1.00000 | 6.1460e−255 | N | 0.249510 | 0.291820 |
| V | E | 26733.1 | 32838.8 | 197868.3 | −36.893349 | 1.00000 | 3.3022e−298 | N | 0.135106 | 0.165963 |
| A | E | 10155.7 | 14278.8 | 89436.9 | −37.640052 | 1.00000 | 0.0000e+00 | N | 0.113552 | 0.159652 |
| G | H | 13372.0 | 17828.1 | 78310.4 | −37.975062 | 1.00000 | 0.0000e+00 | N | 0.170756 | 0.227659 |
| S | C | 79747.1 | 88923.2 | 239515.9 | −38.807598 | 1.00000 | 0.0000e+00 | N | 0.332951 | 0.371262 |
| H | C | 30625.2 | 38464.2 | 98652.4 | −51.171809 | 1.00000 | 0.0000e+00 | N | 0.310435 | 0.389896 |
| A | C | 50800.4 | 63066.5 | 189640.9 | −59.786078 | 1.00000 | 0.0000e+00 | N | 0.267877 | 0.332557 |
| G | C | 105444.1 | 123958.6 | 348901.2 | −65.492096 | 1.00000 | 0.0000e+00 | N | 0.302218 | 0.355283 |

TABLE 5

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| LP | CC | 3644.5 | 2731.7 | 19983.1 | 18.795754 | 4.9663e−79 | 1.00000 | N | 0.182379 | 0.136702 |
| GY | CC | 1961.0 | 1370.5 | 8928.0 | 17.337729 | 1.5760e−67 | 1.00000 | N | 0.219646 | 0.153503 |
| PN | CC | 2684.8 | 2018.2 | 10016.5 | 16.605426 | 3.9173e−62 | 1.00000 | N | 0.268038 | 0.201486 |
| GK | CH | 497.2 | 251.2 | 2101.1 | 16.539879 | 1.6538e−61 | 1.00000 | N | 0.236638 | 0.119564 |
| DG | CC | 5443.5 | 4486.7 | 22101.7 | 16.001152 | 7.1729e−58 | 1.00000 | N | 0.246293 | 0.203000 |
| PG | CC | 5008.5 | 4096.2 | 20210.3 | 15.962799 | 1.3350e−57 | 1.00000 | N | 0.247819 | 0.202681 |
| GF | CC | 1762.8 | 1246.3 | 9499.7 | 15.696619 | 1.0133e−55 | 1.00000 | N | 0.185564 | 0.131193 |
| NG | CC | 4061.8 | 3269.8 | 16386.4 | 15.481858 | 2.6772e−54 | 1.00000 | N | 0.247876 | 0.199541 |
| YP | CC | 1468.8 | 1031.4 | 7236.3 | 14.706553 | 3.7500e−49 | 1.00000 | N | 0.202977 | 0.142537 |
| FP | CC | 1415.6 | 1047.9 | 8539.3 | 12.127760 | 4.6029e−34 | 1.00000 | N | 0.165775 | 0.122713 |
| FG | HC | 520.5 | 323.3 | 2395.7 | 11.793909 | 2.9912e−32 | 1.00000 | N | 0.217301 | 0.134962 |
| PF | CC | 1170.4 | 855.8 | 6117.8 | 11.594115 | 2.7366e−31 | 1.00000 | N | 0.191311 | 0.139893 |
| PE | HH | 2240.3 | 1801.5 | 9246.3 | 11.522645 | 5.9070e−31 | 1.00000 | N | 0.242292 | 0.194830 |
| TE | CH | 705.0 | 481.3 | 2274.8 | 11.486097 | 1.0424e−30 | 1.00000 | N | 0.309917 | 0.211561 |
| CW | HH | 58.9 | 15.3 | 364.3 | 11.413216 | 8.0109e−30 | 1.00000 | N | 0.161680 | 0.041888 |
| AA | HC | 564.4 | 371.6 | 2472.5 | 10.852231 | 1.3234e−27 | 1.00000 | N | 0.228271 | 0.150281 |
| GI | CC | 2094.8 | 1687.9 | 12350.9 | 10.658937 | 9.1167e−27 | 1.00000 | N | 0.169607 | 0.136663 |
| SA | CH | 566.6 | 375.7 | 2576.3 | 10.654750 | 1.1178e−26 | 1.00000 | N | 0.219928 | 0.145839 |
| SP | CH | 805.4 | 571.9 | 3849.5 | 10.583976 | 2.2515e−26 | 1.00000 | N | 0.209222 | 0.148553 |
| AG | CC | 4357.5 | 3776.5 | 21005.1 | 10.439477 | 8.9976e−26 | 1.00000 | N | 0.207450 | 0.179789 |
| PD | CC | 3504.6 | 3007.0 | 14606.8 | 10.183074 | 1.3107e−24 | 1.00000 | N | 0.239929 | 0.205862 |
| TG | HC | 658.1 | 458.6 | 2835.1 | 10.172532 | 1.7080e−24 | 1.00000 | N | 0.232126 | 0.161773 |
| EG | EC | 541.4 | 366.0 | 1983.9 | 10.152241 | 2.1774e−24 | 1.00000 | N | 0.272897 | 0.184467 |
| GL | CC | 3403.1 | 2910.1 | 19636.5 | 9.902246 | 2.2501e−23 | 1.00000 | N | 0.173305 | 0.148198 |
| KY | HC | 311.9 | 189.1 | 1051.9 | 9.856121 | 4.8051e−23 | 1.00000 | N | 0.296511 | 0.179808 |
| SG | HC | 534.7 | 365.2 | 2104.2 | 9.758078 | 1.1308e−22 | 1.00000 | N | 0.254111 | 0.173547 |
| GW | CC | 570.9 | 392.3 | 2987.4 | 9.677790 | 2.4410e−22 | 1.00000 | N | 0.191103 | 0.131303 |
| WG | EC | 172.1 | 86.3 | 1245.8 | 9.578986 | 8.3974e−22 | 1.00000 | N | 0.138144 | 0.069246 |
| PD | HH | 821.7 | 610.6 | 3126.7 | 9.525628 | 1.0190e−21 | 1.00000 | N | 0.262801 | 0.195271 |
| AS | HC | 387.0 | 252.5 | 1734.5 | 9.157518 | 3.6376e−20 | 1.00000 | N | 0.223145 | 0.145589 |
| SL | CH | 583.4 | 412.7 | 2949.5 | 9.062412 | 8.1350e−20 | 1.00000 | N | 0.197796 | 0.139911 |
| SF | EE | 484.7 | 327.4 | 4548.1 | 9.020955 | 1.2109e−19 | 1.00000 | N | 0.106572 | 0.071997 |
| RG | HC | 457.7 | 315.6 | 1580.9 | 8.942867 | 2.5195e−19 | 1.00000 | N | 0.289519 | 0.199616 |
| DH | HC | 131.5 | 66.4 | 320.4 | 8.971856 | 2.7193e−19 | 1.00000 | N | 0.410424 | 0.207256 |
| GN | CC | 3035.8 | 2625.3 | 13860.2 | 8.899244 | 3.0996e−19 | 1.00000 | N | 0.219046 | 0.189411 |
| IP | CC | 1766.5 | 1451.2 | 11589.7 | 8.843319 | 5.2673e−19 | 1.00000 | N | 0.152422 | 0.125234 |
| PQ | HH | 721.3 | 536.6 | 2873.3 | 8.841693 | 5.8387e−19 | 1.00000 | N | 0.251035 | 0.186753 |
| WC | CC | 77.2 | 30.3 | 378.1 | 8.889715 | 7.1536e−19 | 1.00000 | N | 0.204179 | 0.080088 |
| RH | HC | 196.1 | 112.6 | 557.9 | 8.813158 | 9.7271e−19 | 1.00000 | N | 0.351497 | 0.201757 |
| FS | EE | 472.3 | 320.3 | 4887.3 | 8.783719 | 1.0221e−18 | 1.00000 | N | 0.096638 | 0.065543 |

TABLE 5-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GP | CC | 2507.2 | 2140.1 | 12837.1 | 8.692764 | 1.9628e-18 | 1.00000 | N | 0.195309 | 0.166713 |
| HP | CC | 1325.0 | 1066.2 | 6355.9 | 8.687762 | 2.1421e-18 | 1.00000 | N | 0.208468 | 0.167751 |
| PY | CC | 1128.9 | 891.7 | 5689.8 | 8.651118 | 2.9912e-18 | 1.00000 | N | 0.198408 | 0.156714 |
| ER | HC | 439.9 | 308.0 | 1352.8 | 8.554820 | 7.8140e-18 | 1.00000 | N | 0.325177 | 0.227648 |
| TN | CC | 1752.7 | 1460.3 | 7607.1 | 8.511975 | 9.6926e-18 | 1.00000 | N | 0.230403 | 0.191966 |
| HP | CH | 402.9 | 273.6 | 1780.6 | 8.500886 | 1.2479e-17 | 1.00000 | N | 0.226272 | 0.153628 |
| YS | CC | 1057.0 | 832.5 | 5270.8 | 8.480789 | 1.3152e-17 | 1.00000 | N | 0.200539 | 0.157938 |
| VG | EC | 490.3 | 341.1 | 4028.2 | 8.443476 | 1.9615e-17 | 1.00000 | N | 0.121717 | 0.084679 |
| CH | CC | 252.4 | 156.4 | 1105.1 | 8.287375 | 8.3120e-17 | 1.00000 | N | 0.228396 | 0.141505 |
| GS | CE | 476.8 | 337.3 | 2322.9 | 8.216422 | 1.3394e-16 | 1.00000 | N | 0.205261 | 0.145201 |
| EH | HC | 228.4 | 141.7 | 666.7 | 8.208490 | 1.6592e-16 | 1.00000 | N | 0.342583 | 0.212529 |
| PH | CC | 1015.5 | 807.7 | 4323.2 | 8.108741 | 3.0021e-16 | 1.00000 | N | 0.234895 | 0.186827 |
| GF | CE | 273.1 | 171.4 | 2043.3 | 8.118336 | 3.2802e-16 | 1.00000 | N | 0.133656 | 0.083872 |
| EN | HC | 457.8 | 327.9 | 1515.0 | 8.107234 | 3.3452e-16 | 1.00000 | N | 0.302178 | 0.216406 |
| GQ | CE | 454.4 | 324.1 | 1751.3 | 8.019975 | 6.7904e-16 | 1.00000 | N | 0.259464 | 0.185043 |
| CG | CH | 66.5 | 26.7 | 303.6 | 8.076594 | 7.6058e-16 | 1.00000 | N | 0.219038 | 0.087834 |
| QY | CC | 531.1 | 389.0 | 2107.2 | 7.978552 | 9.2897e-16 | 1.00000 | N | 0.252041 | 0.184607 |
| GT | EE | 527.6 | 380.8 | 3779.5 | 7.930985 | 1.3508e-15 | 1.00000 | N | 0.139553 | 0.100763 |
| LG | HC | 956.8 | 758.9 | 5143.0 | 7.782279 | 4.1596e-15 | 1.00000 | N | 0.186039 | 0.147553 |
| RY | HC | 179.4 | 105.7 | 690.9 | 7.786927 | 5.2074e-15 | 1.00000 | N | 0.259661 | 0.153012 |
| CG | CC | 673.3 | 510.2 | 3816.1 | 7.756211 | 5.2757e-15 | 1.00000 | N | 0.176437 | 0.133705 |
| NF | HC | 110.1 | 55.6 | 503.5 | 7.750356 | 8.0006e-15 | 1.00000 | N | 0.218669 | 0.110418 |
| TS | CH | 275.6 | 181.2 | 1047.3 | 7.710340 | 8.6337e-15 | 1.00000 | N | 0.263153 | 0.173029 |
| SV | EE | 859.1 | 668.2 | 9428.4 | 7.661490 | 1.0742e-14 | 1.00000 | N | 0.091118 | 0.070871 |
| KH | HC | 254.7 | 167.1 | 760.9 | 7.669848 | 1.2101e-14 | 1.00000 | N | 0.334735 | 0.219625 |
| SY | CC | 947.1 | 755.4 | 4608.1 | 7.627352 | 1.3977e-14 | 1.00000 | N | 0.205529 | 0.163932 |
| RF | HC | 157.1 | 89.5 | 702.0 | 7.654627 | 1.5033e-14 | 1.00000 | N | 0.223789 | 0.127447 |
| TP | CH | 756.7 | 588.2 | 3562.8 | 7.601796 | 1.7380e-14 | 1.00000 | N | 0.212389 | 0.165105 |
| AG | HC | 665.7 | 508.3 | 3275.0 | 7.597643 | 1.8163e-14 | 1.00000 | N | 0.203267 | 0.155195 |
| QG | HC | 302.1 | 204.5 | 1062.1 | 7.595025 | 2.0764e-14 | 1.00000 | N | 0.284436 | 0.192546 |
| EF | HC | 151.8 | 86.1 | 660.5 | 7.589196 | 2.5096e-14 | 1.00000 | N | 0.229826 | 0.130390 |
| GV | CC | 2697.8 | 2362.0 | 16253.8 | 7.473908 | 4.2358e-14 | 1.00000 | N | 0.165980 | 0.145319 |
| SR | CH | 430.0 | 312.0 | 1576.3 | 7.458081 | 5.5765e-14 | 1.00000 | N | 0.272791 | 0.197943 |
| YH | HH | 259.5 | 168.6 | 1432.6 | 7.457380 | 6.0182e-14 | 1.00000 | N | 0.181139 | 0.117657 |
| HH | HH | 291.1 | 195.1 | 1319.4 | 7.449929 | 6.2606e-14 | 1.00000 | N | 0.220631 | 0.147834 |
| SE | CH | 719.8 | 563.0 | 2748.7 | 7.411761 | 7.4454e-14 | 1.00000 | N | 0.261869 | 0.204817 |
| SG | EE | 554.8 | 413.5 | 3653.5 | 7.381191 | 9.5407e-14 | 1.00000 | N | 0.151854 | 0.113168 |
| HH | HC | 98.4 | 50.9 | 263.6 | 7.406467 | 1.1640e-13 | 1.00000 | N | 0.373293 | 0.193191 |
| ES | EE | 396.4 | 281.8 | 2060.3 | 7.349239 | 1.2662e-13 | 1.00000 | N | 0.192399 | 0.136766 |
| QY | HC | 142.8 | 81.9 | 492.7 | 7.372573 | 1.3154e-13 | 1.00000 | N | 0.289832 | 0.166190 |
| WP | CC | 391.6 | 276.7 | 2395.3 | 7.342160 | 1.3337e-13 | 1.00000 | N | 0.163487 | 0.115532 |
| EN | EC | 274.9 | 184.8 | 998.5 | 7.339252 | 1.4549e-13 | 1.00000 | N | 0.275313 | 0.185106 |
| NN | CC | 1908.2 | 1644.3 | 7974.1 | 7.300124 | 1.5931e-13 | 1.00000 | N | 0.239275 | 0.206200 |
| CH | HH | 134.2 | 74.4 | 694.9 | 7.336557 | 1.7294e-13 | 1.00000 | N | 0.193121 | 0.107068 |
| SR | HC | 280.3 | 190.0 | 982.7 | 7.294196 | 2.0261e-13 | 1.00000 | N | 0.285235 | 0.193343 |
| SN | HC | 268.1 | 180.3 | 936.3 | 7.276429 | 2.3278e-13 | 1.00000 | N | 0.286340 | 0.192571 |
| SQ | CH | 310.6 | 214.4 | 1180.7 | 7.259299 | 2.5698e-13 | 1.00000 | N | 0.263064 | 0.181616 |
| SL | HC | 336.2 | 232.8 | 1884.9 | 7.239376 | 2.9156e-13 | 1.00000 | N | 0.178365 | 0.123503 |
| YQ | EC | 128.8 | 71.9 | 489.2 | 7.264749 | 2.9907e-13 | 1.00000 | N | 0.263287 | 0.146984 |
| NH | CE | 115.1 | 61.8 | 505.6 | 7.245883 | 3.5376e-13 | 1.00000 | N | 0.227650 | 0.122134 |
| PA | CH | 367.6 | 262.5 | 1530.7 | 7.128794 | 6.4728e-13 | 1.00000 | N | 0.240152 | 0.171473 |
| GE | CE | 635.3 | 493.6 | 2532.6 | 7.109712 | 6.9708e-13 | 1.00000 | N | 0.250849 | 0.194887 |
| TG | CC | 3208.1 | 2864.2 | 16191.1 | 7.082544 | 7.6223e-13 | 1.00000 | N | 0.198140 | 0.176900 |
| QF | HC | 113.5 | 61.6 | 439.7 | 7.122281 | 8.7171e-13 | 1.00000 | N | 0.258131 | 0.140203 |
| NY | HC | 149.3 | 88.3 | 580.0 | 7.051042 | 1.3429e-12 | 1.00000 | N | 0.257414 | 0.152234 |
| FT | EE | 494.0 | 365.0 | 5183.9 | 7.003659 | 1.5130e-12 | 1.00000 | N | 0.095295 | 0.070409 |
| QS | EE | 288.5 | 196.3 | 1661.4 | 7.008085 | 1.5838e-12 | 1.00000 | N | 0.173649 | 0.118151 |
| YN | HC | 175.1 | 108.8 | 647.7 | 6.965652 | 2.3708e-12 | 1.00000 | N | 0.270341 | 0.168011 |
| RN | HC | 291.3 | 203.2 | 970.0 | 6.948606 | 2.4377e-12 | 1.00000 | N | 0.300309 | 0.209514 |

TABLE 6

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| SxE | ChH | 1700.4 | 969.9 | 6349.9 | 25.481565 | 2.4624e-143 | 1.00000 | N | 0.267784 | 0.152747 |
| TxE | ChH | 1585.3 | 930.3 | 5513.1 | 23.554174 | 8.6926e-123 | 1.00000 | N | 0.287551 | 0.168742 |
| SxA | ChH | 850.1 | 421.1 | 3347.3 | 22.357026 | 9.2441e-111 | 1.00000 | N | 0.253966 | 0.125812 |
| DxA | ChH | 999.6 | 535.7 | 3592.5 | 21.731401 | 8.6234e-105 | 1.00000 | N | 0.278246 | 0.149103 |
| TxA | ChH | 715.6 | 354.6 | 2588.8 | 20.639026 | 1.1060e-94 | 1.00000 | N | 0.276422 | 0.136960 |
| AxG | HcC | 1022.2 | 597.7 | 4368.0 | 18.691902 | 4.3518e-78 | 1.00000 | N | 0.234020 | 0.136825 |
| NxA | ChH | 528.3 | 260.2 | 2030.4 | 17.797648 | 6.6617e-71 | 1.00000 | N | 0.260195 | 0.128165 |
| DxS | ChH | 748.1 | 418.8 | 2698.0 | 17.510347 | 9.5251e-69 | 1.00000 | N | 0.277279 | 0.155210 |
| NxE | ChH | 840.2 | 510.2 | 3189.6 | 15.940329 | 2.4469e-57 | 1.00000 | N | 0.263419 | 0.159957 |

TABLE 6-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| DxR | ChH | 544.4 | 295.2 | 1961.9 | 15.736436 | 7.0040e−56 | 1.00000 | N | 0.277486 | 0.150465 |
| SxS | ChH | 515.9 | 277.0 | 2080.1 | 15.419244 | 1.0009e−53 | 1.00000 | N | 0.248017 | 0.133156 |
| SxQ | ChH | 428.7 | 217.8 | 1547.0 | 15.412393 | 1.1886e−53 | 1.00000 | N | 0.277117 | 0.140817 |
| DxS | CcC | 2391.5 | 1816.6 | 11758.1 | 14.670190 | 6.0377e−49 | 1.00000 | N | 0.203392 | 0.154495 |
| RxE | EeE | 590.6 | 340.3 | 2432.2 | 14.631398 | 1.3602e−48 | 1.00000 | N | 0.242825 | 0.139910 |
| DxR | CcC | 1514.3 | 1076.2 | 6808.8 | 14.555462 | 3.4368e−48 | 1.00000 | N | 0.222403 | 0.158055 |
| PxE | ChH | 750.1 | 466.0 | 2940.9 | 14.345884 | 8.1316e−47 | 1.00000 | N | 0.255136 | 0.158508 |
| DxE | ChH | 1054.1 | 710.5 | 4231.8 | 14.129521 | 1.6724e−45 | 1.00000 | N | 0.249131 | 0.167933 |
| RxE | ChH | 511.7 | 293.9 | 1726.9 | 13.949854 | 2.4681e−44 | 1.00000 | N | 0.296311 | 0.170167 |
| TxY | EeE | 525.3 | 300.0 | 3697.0 | 13.569099 | 4.6027e−42 | 1.00000 | N | 0.142088 | 0.081150 |
| SxG | HcC | 511.7 | 296.4 | 2101.8 | 13.496246 | 1.2581e−41 | 1.00000 | N | 0.243458 | 0.141004 |
| DxD | ChH | 676.9 | 423.4 | 2579.0 | 13.477926 | 1.5116e−41 | 1.00000 | N | 0.262466 | 0.164158 |
| TxQ | ChH | 358.8 | 189.9 | 1213.7 | 13.347342 | 1.0422e−40 | 1.00000 | N | 0.295625 | 0.156445 |
| KxG | HhC | 794.3 | 518.5 | 3293.5 | 13.196235 | 6.3329e−40 | 1.00000 | N | 0.241172 | 0.157426 |
| ExG | HcC | 907.8 | 610.7 | 3653.9 | 13.173395 | 8.3719e−40 | 1.00000 | N | 0.248447 | 0.167137 |
| YxG | EcC | 388.8 | 209.7 | 2305.9 | 12.974743 | 1.3641e−38 | 1.00000 | N | 0.168611 | 0.090928 |
| SxD | ChH | 668.8 | 424.4 | 2701.0 | 12.924936 | 2.2948e−38 | 1.00000 | N | 0.247612 | 0.157111 |
| DxQ | ChH | 411.3 | 232.6 | 1454.6 | 12.781923 | 1.6375e−37 | 1.00000 | N | 0.282758 | 0.159919 |
| ExG | HhC | 887.1 | 600.4 | 3922.9 | 12.716402 | 3.1827e−37 | 1.00000 | N | 0.226134 | 0.153038 |
| AxG | HhC | 719.4 | 465.5 | 3596.3 | 12.614343 | 1.2059e−36 | 1.00000 | N | 0.200039 | 0.129430 |
| KxG | HcC | 815.5 | 546.9 | 3223.8 | 12.605467 | 1.3261e−36 | 1.00000 | N | 0.252962 | 0.169638 |
| SxW | ChH | 89.6 | 27.5 | 434.3 | 12.254000 | 2.6846e−34 | 1.00000 | N | 0.206309 | 0.063216 |
| VxC | EcC | 60.4 | 14.6 | 326.9 | 12.283869 | 2.8734e−34 | 1.00000 | N | 0.184766 | 0.044568 |
| TxD | ChH | 596.6 | 380.9 | 2366.4 | 12.065391 | 1.1295e−33 | 1.00000 | N | 0.252113 | 0.160964 |
| QxG | HcC | 492.4 | 302.3 | 1853.5 | 11.951463 | 4.6538e−33 | 1.00000 | N | 0.265660 | 0.163098 |
| RxG | HcC | 600.4 | 385.3 | 2430.5 | 11.946166 | 4.7458e−33 | 1.00000 | N | 0.247027 | 0.158526 |
| LxP | CcH | 462.1 | 275.0 | 3282.8 | 11.786533 | 3.3267e−32 | 1.00000 | N | 0.140764 | 0.083772 |
| PxD | ChH | 394.7 | 232.9 | 1487.4 | 11.547933 | 5.7222e−31 | 1.00000 | N | 0.265362 | 0.156556 |
| DxN | ChH | 418.4 | 250.6 | 1597.8 | 11.545587 | 5.7935e−31 | 1.00000 | N | 0.261860 | 0.156827 |
| PxS | ChH | 359.8 | 206.0 | 1492.8 | 11.543336 | 6.1661e−31 | 1.00000 | N | 0.241024 | 0.137984 |
| NxR | ChH | 288.4 | 155.7 | 1067.1 | 11.503618 | 1.0444e−30 | 1.00000 | N | 0.270265 | 0.145939 |
| SxR | ChH | 317.2 | 175.7 | 1335.1 | 11.460734 | 1.6564e−30 | 1.00000 | N | 0.237585 | 0.131564 |
| GxC | CcH | 44.3 | 9.7 | 152.7 | 11.437654 | 9.0069e−30 | 1.00000 | N | 0.290111 | 0.063838 |
| SxY | ChH | 163.2 | 72.1 | 829.5 | 11.220669 | 3.2336e−29 | 1.00000 | N | 0.196745 | 0.086964 |
| QxF | EeE | 222.0 | 109.4 | 1489.4 | 11.185189 | 4.2124e−29 | 1.00000 | N | 0.149053 | 0.073447 |
| GxT | ChH | 279.3 | 149.2 | 1676.8 | 11.158528 | 5.2645e−29 | 1.00000 | N | 0.166567 | 0.088982 |
| NxD | ChH | 495.1 | 313.9 | 2040.0 | 11.121331 | 6.9636e−29 | 1.00000 | N | 0.242696 | 0.153854 |
| NxQ | ChH | 274.2 | 149.6 | 988.7 | 11.058345 | 1.6363e−28 | 1.00000 | N | 0.277334 | 0.151307 |
| NxN | ChH | 250.9 | 133.3 | 909.1 | 11.031095 | 2.2760e−28 | 1.00000 | N | 0.275987 | 0.146586 |
| QxI | EeE | 286.5 | 155.2 | 2264.8 | 10.922487 | 7.1076e−28 | 1.00000 | N | 0.126501 | 0.068519 |
| RxD | ChH | 290.3 | 164.7 | 1023.0 | 10.679839 | 9.9908e−27 | 1.00000 | N | 0.283773 | 0.161040 |
| RxG | HhC | 536.7 | 352.1 | 2365.3 | 10.663828 | 1.0247e−26 | 1.00000 | N | 0.226906 | 0.148858 |
| RxY | EeE | 321.4 | 183.3 | 2132.7 | 10.666316 | 1.1077e−26 | 1.00000 | N | 0.150701 | 0.085960 |
| PxN | ChH | 192.2 | 95.7 | 703.2 | 10.613987 | 2.3079e−26 | 1.00000 | N | 0.273322 | 0.136083 |
| GxP | CcC | 2805.0 | 2335.4 | 17106.8 | 10.456739 | 7.6737e−26 | 1.00000 | N | 0.163970 | 0.136520 |
| SxT | ChH | 257.9 | 141.7 | 1197.1 | 10.391203 | 2.1709e−25 | 1.00000 | N | 0.215437 | 0.118404 |
| QxN | EeE | 209.1 | 109.1 | 732.3 | 10.376889 | 2.7159e−25 | 1.00000 | N | 0.285529 | 0.148994 |
| DxY | EeE | 220.1 | 114.3 | 1491.6 | 10.296246 | 6.0672e−25 | 1.00000 | N | 0.147560 | 0.076640 |
| SxN | ChH | 239.0 | 129.9 | 996.5 | 10.263686 | 8.3511e−25 | 1.00000 | N | 0.239839 | 0.130365 |
| DxG | HcC | 432.5 | 277.7 | 1780.1 | 10.113180 | 3.3685e−24 | 1.00000 | N | 0.242964 | 0.155990 |
| YxY | EeE | 228.8 | 121.2 | 2218.0 | 10.058017 | 6.7978e−24 | 1.00000 | N | 0.103156 | 0.054624 |
| NxQ | CcC | 892.6 | 658.1 | 4118.3 | 9.972648 | 1.2435e−23 | 1.00000 | N | 0.216740 | 0.159798 |
| ExR | EeE | 515.0 | 343.7 | 2444.0 | 9.970753 | 1.3711e−23 | 1.00000 | N | 0.210720 | 0.140610 |
| GxT | CcE | 939.2 | 694.3 | 5432.7 | 9.951870 | 1.5175e−23 | 1.00000 | N | 0.172879 | 0.127800 |
| GxV | CcE | 809.8 | 580.9 | 6541.4 | 9.949285 | 1.5796e−23 | 1.00000 | N | 0.123796 | 0.088803 |
| NxY | CcE | 207.7 | 110.3 | 1062.5 | 9.790792 | 1.0127e−22 | 1.00000 | N | 0.195482 | 0.103850 |
| PxY | CcC | 713.9 | 507.6 | 4347.2 | 9.740513 | 1.2772e−22 | 1.00000 | N | 0.164221 | 0.116776 |
| AxP | HcC | 365.8 | 228.9 | 1699.7 | 9.723656 | 1.6933e−22 | 1.00000 | N | 0.215214 | 0.134695 |
| ExF | EeE | 256.9 | 144.6 | 1850.1 | 9.723236 | 1.8348e−22 | 1.00000 | N | 0.138857 | 0.078174 |
| QxG | HhC | 389.7 | 248.6 | 1652.1 | 9.705388 | 2.0025e−22 | 1.00000 | N | 0.235882 | 0.150503 |
| TxS | ChH | 302.5 | 183.7 | 1336.5 | 9.440319 | 2.7128e−21 | 1.00000 | N | 0.226337 | 0.137430 |
| TxV | EeE | 635.9 | 444.3 | 7269.4 | 9.382032 | 4.0803e−21 | 1.00000 | N | 0.087476 | 0.061117 |
| PxA | ChH | 300.2 | 182.7 | 1377.9 | 9.335371 | 7.3154e−21 | 1.00000 | N | 0.217868 | 0.132582 |
| SxG | HhC | 349.5 | 220.3 | 1705.1 | 9.325761 | 7.7389e−21 | 1.00000 | N | 0.204973 | 0.129216 |
| ExR | CeE | 196.5 | 108.0 | 664.3 | 9.299003 | 1.1605e−20 | 1.00000 | N | 0.295800 | 0.162652 |
| QxY | EeE | 187.6 | 98.9 | 1255.4 | 9.293234 | 1.2227e−20 | 1.00000 | N | 0.149434 | 0.078777 |
| GxR | CcE | 762.1 | 561.9 | 3614.7 | 9.192475 | 2.3756e−20 | 1.00000 | N | 0.210834 | 0.155436 |
| DxR | HcC | 120.8 | 57.1 | 342.9 | 9.241439 | 2.3884e−20 | 1.00000 | N | 0.352289 | 0.166413 |
| LxA | CcH | 231.9 | 130.5 | 1826.3 | 9.214022 | 2.3961e−20 | 1.00000 | N | 0.126978 | 0.071445 |
| DxG | HhC | 361.9 | 232.4 | 1588.1 | 9.195611 | 2.5922e−20 | 1.00000 | N | 0.227882 | 0.146327 |
| CxP | ChH | 38.6 | 10.0 | 195.9 | 9.318972 | 2.6851e−20 | 1.00000 | N | 0.197039 | 0.050815 |
| YxY | CcE | 84.9 | 33.4 | 504.5 | 9.207153 | 3.8374e−20 | 1.00000 | N | 0.168285 | 0.066298 |
| NxS | ChH | 286.4 | 174.8 | 1258.8 | 9.101010 | 6.5075e−20 | 1.00000 | N | 0.227518 | 0.138825 |
| RxP | HcC | 272.6 | 165.4 | 1046.7 | 9.080465 | 7.9710e−20 | 1.00000 | N | 0.260438 | 0.158052 |
| DxT | ChH | 325.9 | 205.3 | 1490.9 | 9.064351 | 8.8406e−20 | 1.00000 | N | 0.218593 | 0.137700 |
| TxK | ChH | 363.6 | 237.5 | 1518.2 | 8.909320 | 3.5284e−19 | 1.00000 | N | 0.239494 | 0.156432 |
| DxN | CcC | 1643.8 | 1344.4 | 8702.1 | 8.880344 | 3.8076e−19 | 1.00000 | N | 0.188897 | 0.154491 |

TABLE 6-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxC | EcH | 23.6 | 2.0 | 59.1 | 15.334095 | 4.9477e-19 | 1.00000 | B | 0.399323 | 0.034629 |
| WxG | CcH | 47.8 | 14.9 | 153.6 | 8.967722 | 5.1676e-19 | 1.00000 | N | 0.311198 | 0.097025 |
| RxF | EeE | 260.1 | 154.0 | 2165.0 | 8.868217 | 5.4042e-19 | 1.00000 | N | 0.120139 | 0.071144 |
| NxQ | CcE | 241.5 | 143.8 | 921.8 | 8.867344 | 5.6237e-19 | 1.00000 | N | 0.261987 | 0.156009 |
| NxG | HcC | 306.9 | 192.6 | 1423.3 | 8.859907 | 5.6640e-19 | 1.00000 | N | 0.215626 | 0.135299 |
| NxG | EcC | 266.8 | 161.1 | 1531.2 | 8.808720 | 9.1688e-19 | 1.00000 | N | 0.174242 | 0.105181 |
| DxY | ChH | 151.5 | 78.1 | 697.2 | 8.818579 | 9.8907e-19 | 1.00000 | N | 0.217298 | 0.111980 |
| DxR | EeE | 241.4 | 143.3 | 1105.4 | 8.782154 | 1.1928e-18 | 1.00000 | N | 0.218382 | 0.129651 |
| GxW | CcE | 181.9 | 98.7 | 1119.5 | 8.764418 | 1.4965e-18 | 1.00000 | N | 0.162483 | 0.088199 |
| YxE | EeE | 316.8 | 199.4 | 2122.7 | 8.730258 | 1.7640e-18 | 1.00000 | N | 0.149244 | 0.093957 |
| SxN | HcC | 189.6 | 106.4 | 732.9 | 8.717704 | 2.2519e-18 | 1.00000 | N | 0.258698 | 0.145238 |
| VxK | CcH | 158.9 | 83.0 | 1054.7 | 8.679088 | 3.2923e-18 | 1.00000 | N | 0.150659 | 0.078699 |
| ExR | HcC | 208.6 | 122.8 | 704.9 | 8.523866 | 1.1834e-17 | 1.00000 | N | 0.295929 | 0.174169 |

TABLE 7

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| VGK | CCH | 77.0 | 7.3 | 333.8 | 26.010341 | 2.4051e-147 | 1.00000 | N | 0.230677 | 0.021974 |
| GKT | CHH | 153.4 | 31.1 | 637.2 | 22.460983 | 3.9337e-111 | 1.00000 | N | 0.240741 | 0.048882 |
| AGK | CCH | 62.8 | 6.9 | 203.7 | 21.675549 | 1.1541e-102 | 1.00000 | N | 0.308297 | 0.033809 |
| GKS | CHH | 109.3 | 20.3 | 431.2 | 20.202696 | 4.5922e-90 | 1.00000 | N | 0.253479 | 0.047186 |
| SGK | CCH | 62.0 | 8.1 | 285.5 | 19.164056 | 1.1096e-80 | 1.00000 | N | 0.217163 | 0.028485 |
| TGK | CCH | 58.3 | 9.7 | 201.6 | 15.993902 | 9.7605e-57 | 1.00000 | N | 0.289187 | 0.048116 |
| SCW | CHH | 23.8 | 0.1 | 62.0 | 65.127700 | 4.1919e-46 | 1.00000 | B | 0.383871 | 0.002135 |
| KTT | HHH | 82.7 | 23.0 | 432.3 | 12.788449 | 3.7526e-37 | 1.00000 | N | 0.191302 | 0.053227 |
| GLG | CHH | 32.3 | 5.5 | 150.3 | 11.613338 | 2.1761e-30 | 1.00000 | N | 0.214904 | 0.036728 |
| VAC | ECC | 35.5 | 3.0 | 69.4 | 19.303678 | 1.0904e-29 | 1.00000 | B | 0.511527 | 0.042754 |
| ACK | CCC | 43.1 | 9.6 | 105.9 | 11.302265 | 4.3157e-29 | 1.00000 | N | 0.406988 | 0.091043 |
| STK | CEE | 101.6 | 38.9 | 261.2 | 10.906198 | 1.3949e-27 | 1.00000 | N | 0.388974 | 0.148807 |
| NVA | EEC | 38.6 | 8.4 | 107.2 | 10.808062 | 1.0942e-26 | 1.00000 | N | 0.360045 | 0.078810 |
| SWG | EEC | 39.0 | 8.5 | 240.0 | 10.655127 | 5.3105e-26 | 1.00000 | N | 0.162500 | 0.035402 |
| LCT | CCC | 29.6 | 5.8 | 90.5 | 10.256670 | 5.0074e-24 | 1.00000 | N | 0.327072 | 0.063723 |
| CKN | CCC | 43.3 | 11.3 | 142.4 | 9.894711 | 1.0185e-22 | 1.00000 | N | 0.304073 | 0.079616 |
| AAG | HCC | 163.7 | 81.2 | 702.7 | 9.726602 | 2.0695e-22 | 1.00000 | N | 0.232959 | 0.115625 |
| TEA | CHH | 96.0 | 39.7 | 292.4 | 9.607131 | 8.5115e-22 | 1.00000 | N | 0.328317 | 0.135830 |
| SAA | CHH | 97.7 | 40.5 | 376.8 | 9.504205 | 2.2325e-21 | 1.00000 | N | 0.259289 | 0.107580 |
| ACW | CHH | 7.1 | 0.0 | 7.0 | 66.349669 | 2.5416e-20 | 1.00000 | B | 1.014286 | 0.001588 |
| TNS | HHH | 28.8 | 6.4 | 113.7 | 9.149010 | 1.8584e-19 | 1.00000 | N | 0.253298 | 0.056008 |
| GLP | CCC | 279.5 | 169.6 | 1833.1 | 8.854745 | 6.0139e-19 | 1.00000 | N | 0.152474 | 0.092541 |
| NIF | CHH | 25.6 | 5.4 | 79.2 | 9.005026 | 8.0205e-19 | 1.00000 | N | 0.323232 | 0.068183 |
| SIP | CCC | 122.5 | 58.7 | 674.0 | 8.717895 | 2.5843e-18 | 1.00000 | N | 0.181751 | 0.087074 |
| WCG | CCH | 28.7 | 4.0 | 56.9 | 12.768736 | 3.8448e-18 | 1.00000 | B | 0.504394 | 0.070649 |
| FPG | CCC | 138.7 | 69.5 | 857.5 | 8.665190 | 3.8961e-18 | 1.00000 | N | 0.161749 | 0.081010 |
| GFT | CCH | 31.4 | 8.1 | 73.3 | 8.717496 | 7.2684e-18 | 1.00000 | N | 0.428377 | 0.109906 |
| FTN | CHH | 29.5 | 7.6 | 58.8 | 8.553956 | 3.1605e-17 | 1.00000 | N | 0.501701 | 0.128453 |
| QFN | CEC | 25.0 | 3.5 | 41.7 | 12.091685 | 4.5918e-17 | 1.00000 | B | 0.599520 | 0.082983 |
| PGP | CCC | 141.6 | 73.8 | 708.1 | 8.346900 | 5.8862e-17 | 1.00000 | N | 0.199972 | 0.104156 |
| CSA | CCC | 35.9 | 10.0 | 203.2 | 8.423091 | 7.2418e-17 | 1.00000 | N | 0.176673 | 0.049053 |
| NHG | CEE | 10.8 | 0.2 | 15.3 | 24.175566 | 8.8421e-17 | 1.00000 | B | 0.705882 | 0.012739 |
| PTW | CEE | 16.2 | 1.1 | 23.2 | 14.652981 | 1.4058e-16 | 1.00000 | B | 0.698276 | 0.047995 |
| SRW | CHH | 21.5 | 2.1 | 52.8 | 13.577010 | 2.1455e-16 | 1.00000 | B | 0.407167 | 0.040196 |
| MDS | ECC | 25.5 | 3.2 | 83.9 | 12.774800 | 2.5660e-16 | 1.00000 | B | 0.303933 | 0.037835 |
| STM | CCE | 24.9 | 3.3 | 57.0 | 12.327304 | 3.1613e-16 | 1.00000 | B | 0.436842 | 0.057314 |
| CGP | CHH | 24.5 | 3.1 | 61.6 | 12.501422 | 4.2984e-16 | 1.00000 | B | 0.397727 | 0.050135 |
| AGP | CCC | 129.7 | 67.0 | 642.9 | 8.089518 | 5.0769e-16 | 1.00000 | N | 0.201742 | 0.104248 |
| GSC | CCH | 17.4 | 1.2 | 46.8 | 14.920627 | 7.5249e-16 | 1.00000 | B | 0.371795 | 0.025829 |
| TKV | EEE | 147.9 | 80.2 | 815.1 | 7.963248 | 1.3456e-15 | 1.00000 | N | 0.181450 | 0.098379 |
| TVA | CHH | 40.3 | 13.0 | 137.0 | 7.949197 | 3.0102e-15 | 1.00000 | N | 0.294161 | 0.095013 |
| QGQ | CCC | 91.8 | 43.4 | 358.2 | 7.828759 | 4.6739e-15 | 1.00000 | N | 0.256243 | 0.121185 |
| SVT | EEE | 97.7 | 46.7 | 1097.4 | 7.630634 | 2.0807e-14 | 1.00000 | N | 0.089045 | 0.042549 |
| YPS | CCC | 75.2 | 33.3 | 377.0 | 7.598203 | 3.0137e-14 | 1.00000 | N | 0.199469 | 0.088388 |
| LSA | CCH | 54.0 | 20.6 | 304.8 | 7.618303 | 3.0894e-14 | 1.00000 | N | 0.177165 | 0.067607 |
| TPG | CCC | 165.0 | 95.3 | 927.4 | 7.542830 | 3.4767e-14 | 1.00000 | N | 0.177936 | 0.102732 |
| GSC | ECH | 11.5 | 0.4 | 30.6 | 17.936056 | 4.0165e-14 | 1.00000 | B | 0.375817 | 0.012703 |
| KVD | EEE | 140.3 | 78.3 | 634.6 | 7.478628 | 5.9323e-14 | 1.00000 | N | 0.221084 | 0.123433 |
| VNG | ECC | 97.3 | 47.6 | 641.0 | 7.485467 | 6.3078e-14 | 1.00000 | N | 0.151794 | 0.074270 |
| NHA | CEE | 13.1 | 0.7 | 39.4 | 15.069522 | 8.1696e-14 | 1.00000 | B | 0.332487 | 0.017519 |
| DAC | ECC | 11.1 | 0.4 | 76.4 | 17.855983 | 1.1616e-13 | 1.00000 | B | 0.145288 | 0.004755 |
| PTE | CCH | 41.7 | 14.5 | 177.9 | 7.447010 | 1.3352e-13 | 1.00000 | N | 0.234401 | 0.081576 |
| VNT | EEE | 23.7 | 5.8 | 202.1 | 7.516216 | 1.3762e-13 | 1.00000 | N | 0.117269 | 0.028818 |
| QRG | HCC | 49.4 | 19.2 | 147.2 | 7.401983 | 1.6748e-13 | 1.00000 | N | 0.335598 | 0.130253 |
| DRC | CCC | 32.2 | 9.8 | 128.7 | 7.444459 | 1.6904e-13 | 1.00000 | N | 0.250194 | 0.076146 |

TABLE 7-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| TPN | CHH | 40.3 | 14.1 | 123.0 | 7.419598 | 1.6934e-13 | 1.00000 | N | 0.327642 | 0.114566 |
| QSP | EEC | 55.5 | 22.0 | 358.1 | 7.386743 | 1.7114e-13 | 1.00000 | N | 0.154985 | 0.061328 |
| NPT | CCC | 103.0 | 52.3 | 577.1 | 7.347429 | 1.7329e-13 | 1.00000 | N | 0.178479 | 0.090661 |
| PGA | CCC | 212.4 | 132.7 | 1275.2 | 7.304192 | 1.9593e-13 | 1.00000 | N | 0.166562 | 0.104098 |
| TMS | CEE | 18.0 | 1.9 | 61.6 | 11.976454 | 2.1832e-13 | 1.00000 | B | 0.292208 | 0.030366 |
| WNI | ECC | 14.3 | 1.7 | 14.6 | 10.368372 | 2.5065e-13 | 1.00000 | B | 0.979452 | 0.114714 |
| SLP | CCC | 173.3 | 103.4 | 1051.9 | 7.242306 | 3.2273e-13 | 1.00000 | N | 0.164750 | 0.098276 |
| VWG | CCC | 27.0 | 7.6 | 100.7 | 7.352114 | 3.9459e-13 | 1.00000 | N | 0.268123 | 0.075068 |
| YAS | HHC | 21.3 | 5.1 | 83.8 | 7.373798 | 4.4718e-13 | 1.00000 | N | 0.254177 | 0.061159 |
| ETG | HHC | 74.9 | 34.7 | 331.4 | 7.207961 | 5.4644e-13 | 1.00000 | N | 0.226011 | 0.104757 |
| DGR | CCC | 235.9 | 153.2 | 1180.8 | 7.159780 | 5.5359e-13 | 1.00000 | N | 0.199780 | 0.129763 |
| PGD | CCC | 199.2 | 124.2 | 1125.9 | 7.138468 | 6.6622e-13 | 1.00000 | N | 0.176925 | 0.110285 |
| KYG | HHC | 97.9 | 50.3 | 426.2 | 7.139373 | 8.0699e-13 | 1.00000 | N | 0.229704 | 0.118099 |
| PNR | HHH | 26.3 | 7.4 | 104.2 | 7.227147 | 9.8791e-13 | 1.00000 | N | 0.252399 | 0.070802 |
| YRG | ECC | 44.6 | 16.9 | 163.1 | 7.137134 | 1.2043e-12 | 1.00000 | N | 0.273452 | 0.103338 |
| LPP | CCH | 51.0 | 20.2 | 286.8 | 7.109054 | 1.3390e-12 | 1.00000 | N | 0.177824 | 0.070421 |
| ALG | HHC | 97.2 | 49.6 | 629.4 | 7.045039 | 1.5728e-12 | 1.00000 | N | 0.154433 | 0.078782 |
| LPP | CCC | 180.4 | 110.2 | 1229.1 | 7.014972 | 1.6415e-12 | 1.00000 | N | 0.146774 | 0.089620 |
| VPG | CCC | 166.4 | 99.6 | 1134.4 | 7.006024 | 1.7808e-12 | 1.00000 | N | 0.146685 | 0.087813 |
| GLN | CCC | 129.0 | 72.3 | 760.8 | 7.013456 | 1.8054e-12 | 1.00000 | N | 0.169558 | 0.095002 |
| DGS | CCC | 313.8 | 217.4 | 1868.1 | 6.955249 | 2.2714e-12 | 1.00000 | N | 0.167978 | 0.116375 |
| TQA | CHH | 28.7 | 8.8 | 79.5 | 7.084686 | 2.4870e-12 | 1.00000 | N | 0.361066 | 0.111203 |
| LGF | HCC | 32.9 | 10.6 | 200.8 | 7.063506 | 2.5027e-12 | 1.00000 | N | 0.163845 | 0.052585 |
| VGS | ECC | 50.8 | 20.2 | 338.6 | 7.014581 | 2.6019e-12 | 1.00000 | N | 0.150030 | 0.059706 |
| VGG | ECC | 71.2 | 32.4 | 623.7 | 6.989302 | 2.6159e-12 | 1.00000 | N | 0.114157 | 0.052013 |
| DAG | HCC | 85.4 | 43.1 | 354.4 | 6.866307 | 5.8013e-12 | 1.00000 | N | 0.240971 | 0.121717 |
| NFQ | CCC | 43.0 | 16.4 | 179.3 | 6.908802 | 6.0451e-12 | 1.00000 | N | 0.239822 | 0.091247 |
| PLP | CCC | 188.1 | 117.9 | 1190.8 | 6.815600 | 6.5703e-12 | 1.00000 | N | 0.157961 | 0.098979 |
| GVG | CCC | 153.3 | 91.0 | 1178.1 | 6.798433 | 7.7111e-12 | 1.00000 | N | 0.130125 | 0.077244 |
| KST | HHH | 55.7 | 23.6 | 352.4 | 6.836180 | 8.5034e-12 | 1.00000 | N | 0.158059 | 0.067006 |
| GVC | CHH | 11.0 | 0.6 | 29.2 | 13.353406 | 1.0076e-11 | 1.00000 | B | 0.376712 | 0.021150 |
| LNH | CCE | 18.5 | 2.6 | 48.2 | 10.211731 | 1.1142e-11 | 1.00000 | B | 0.383817 | 0.053329 |
| FNT | ECC | 25.2 | 5.0 | 90.3 | 9.300990 | 1.1273e-11 | 1.00000 | B | 0.279070 | 0.055319 |
| AFG | HHC | 43.0 | 16.4 | 221.9 | 6.811870 | 1.1651e-11 | 1.00000 | N | 0.193781 | 0.074044 |
| YDY | CCE | 24.7 | 7.0 | 113.0 | 6.871379 | 1.2210e-11 | 1.00000 | N | 0.218584 | 0.062322 |
| EFG | HHC | 47.2 | 19.1 | 189.4 | 6.788653 | 1.2971e-11 | 1.00000 | N | 0.249208 | 0.100739 |
| GAD | CCC | 214.2 | 138.8 | 1524.5 | 6.711627 | 1.3044e-11 | 1.00000 | N | 0.140505 | 0.091053 |
| PGY | CCC | 82.9 | 41.6 | 425.5 | 6.738554 | 1.3978e-11 | 1.00000 | N | 0.194830 | 0.097795 |
| VSG | ECC | 37.7 | 13.5 | 238.1 | 6.793587 | 1.4324e-11 | 1.00000 | N | 0.158337 | 0.056600 |
| VPS | CHH | 23.5 | 6.7 | 71.3 | 6.843087 | 1.5709e-11 | 1.00000 | N | 0.329593 | 0.093573 |
| NTK | CEE | 60.7 | 27.9 | 192.9 | 6.723444 | 1.7833e-11 | 1.00000 | N | 0.314671 | 0.144478 |
| KEG | HHC | 69.4 | 33.3 | 254.1 | 6.699047 | 1.9722e-11 | 1.00000 | N | 0.273121 | 0.131224 |
| ERG | HCC | 94.3 | 50.4 | 359.7 | 6.658952 | 2.3048e-11 | 1.00000 | N | 0.262163 | 0.140245 |
| TGN | CCH | 20.5 | 3.8 | 35.3 | 8.996500 | 2.3578e-11 | 1.00000 | B | 0.580737 | 0.108948 |

TABLE 8

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ExxR | HhhH | 4348.2 | 2217.2 | 15346.0 | 48.929948 | 0.0000e+00 | 1.00000 | N | 0.283344 | 0.144479 |
| DxxR | HhhH | 1950.8 | 1065.5 | 7576.4 | 29.254482 | 3.1941e-188 | 1.00000 | N | 0.257484 | 0.140641 |
| AxxR | HhhH | 1961.9 | 1175.2 | 11570.1 | 24.209128 | 1.2946e-129 | 1.00000 | N | 0.169566 | 0.101576 |
| QxxR | HhhH | 1231.2 | 658.8 | 5042.5 | 23.915382 | 1.7473e-126 | 1.00000 | N | 0.244165 | 0.130659 |
| RxxE | HhhH | 2176.8 | 1363.9 | 9113.5 | 23.870272 | 4.4302e-126 | 1.00000 | N | 0.238854 | 0.149656 |
| SxxE | ChhH | 1232.3 | 662.1 | 5215.8 | 23.715081 | 2.0648e-124 | 1.00000 | N | 0.236263 | 0.126945 |
| TxxE | HhhH | 1201.2 | 669.0 | 5025.4 | 22.099248 | 2.5443e-108 | 1.00000 | N | 0.239026 | 0.133125 |
| RxxR | HhhH | 1439.9 | 849.7 | 5869.7 | 21.892063 | 2.3219e-106 | 1.00000 | N | 0.245311 | 0.144767 |
| NxxR | HhhH | 887.4 | 483.2 | 3933.1 | 19.632154 | 6.6235e-86 | 1.00000 | N | 0.225624 | 0.122860 |
| ExxL | HhhH | 2067.7 | 1372.8 | 16331.3 | 19.596830 | 1.0853e-85 | 1.00000 | N | 0.126610 | 0.084059 |
| ExxE | HhhH | 2778.6 | 2009.6 | 13291.7 | 18.618528 | 1.4251e-77 | 1.00000 | N | 0.209048 | 0.151195 |
| RxxQ | HhhH | 1120.7 | 683.5 | 5021.9 | 17.993739 | 1.5808e-72 | 1.00000 | N | 0.223198 | 0.136120 |
| AxxA | HhhH | 1938.9 | 1310.0 | 22725.8 | 17.898378 | 7.8366e-72 | 1.00000 | N | 0.085317 | 0.057645 |
| LxxQ | HhhH | 1044.9 | 618.7 | 8365.8 | 17.803559 | 4.8141e-71 | 1.00000 | N | 0.124901 | 0.073960 |
| TxxQ | ChhH | 610.2 | 320.7 | 2537.9 | 17.349010 | 1.6872e-67 | 1.00000 | N | 0.240632 | 0.126252 |
| LxxE | HhhH | 1464.3 | 953.5 | 12363.8 | 17.217744 | 1.3074e-66 | 1.00000 | N | 0.118434 | 0.077123 |
| SxxR | HhhH | 897.4 | 526.5 | 4584.1 | 17.180436 | 2.7728e-66 | 1.00000 | N | 0.195764 | 0.114856 |
| PxxR | HhhH | 724.7 | 403.3 | 3049.0 | 17.179959 | 2.9726e-66 | 1.00000 | N | 0.237684 | 0.132276 |
| ExxK | HhhH | 3386.3 | 2586.3 | 16930.7 | 17.087679 | 1.1008e-65 | 1.00000 | N | 0.200004 | 0.152759 |
| ExxG | HhhC | 927.7 | 556.9 | 3737.1 | 17.076826 | 1.6364e-65 | 1.00000 | N | 0.248241 | 0.148819 |
| NxxE | ChhH | 661.0 | 364.0 | 2655.9 | 16.758653 | 3.9327e-63 | 1.00000 | N | 0.248880 | 0.137048 |
| AxxG | HhhC | 719.2 | 401.9 | 3735.5 | 16.753239 | 4.1779e-63 | 1.00000 | N | 0.192531 | 0.107594 |
| ExxH | HhhH | 621.9 | 333.5 | 3030.1 | 16.736834 | 5.7488e-63 | 1.00000 | N | 0.205241 | 0.110077 |
| ExxA | HhhH | 2290.7 | 1653.8 | 15597.0 | 16.562861 | 8.0240e-62 | 1.00000 | N | 0.146868 | 0.106036 |

TABLE 8-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| QxxE | HhhH | 1402.9 | 938.5 | 6562.3 | 16.375826 | 1.9012e−60 | 1.00000 | N | 0.213782 | 0.143012 |
| AxxQ | HhhH | 1213.0 | 780.1 | 7792.0 | 16.340013 | 3.4909e−60 | 1.00000 | N | 0.155672 | 0.100112 |
| QxxQ | HhhH | 966.0 | 596.4 | 4465.5 | 16.256537 | 1.4369e−59 | 1.00000 | N | 0.216325 | 0.133567 |
| SxxQ | ChhH | 506.0 | 259.3 | 2528.0 | 16.170844 | 6.8893e−59 | 1.00000 | N | 0.200158 | 0.102577 |
| QxxA | HhhH | 1224.8 | 792.5 | 8547.3 | 16.121839 | 1.2114e−58 | 1.00000 | N | 0.143297 | 0.092719 |
| AxxE | HhhH | 1984.0 | 1414.1 | 13871.6 | 15.991423 | 9.1835e−58 | 1.00000 | N | 0.143029 | 0.101946 |
| ExxN | HhhH | 1108.5 | 713.4 | 5126.3 | 15.942068 | 2.2333e−57 | 1.00000 | N | 0.216238 | 0.139170 |
| QxxL | HhhH | 1100.1 | 695.9 | 9726.7 | 15.900088 | 4.3300e−57 | 1.00000 | N | 0.113101 | 0.071549 |
| QxxK | HhhH | 1225.8 | 809.9 | 5705.9 | 15.775674 | 3.0884e−56 | 1.00000 | N | 0.214830 | 0.141944 |
| KxxG | HhhC | 867.2 | 534.5 | 3433.8 | 15.658935 | 2.0892e−55 | 1.00000 | N | 0.252548 | 0.155669 |
| NxxQ | ChhH | 332.0 | 152.1 | 1273.6 | 15.544051 | 1.7117e−54 | 1.00000 | N | 0.260637 | 0.119410 |
| SxxQ | HhhH | 668.9 | 384.6 | 3261.9 | 15.434403 | 7.3145e−54 | 1.00000 | N | 0.205065 | 0.117911 |
| RxxG | HhhC | 641.9 | 369.4 | 2583.0 | 15.313256 | 4.8017e−53 | 1.00000 | N | 0.248509 | 0.143024 |
| SxxD | ChhH | 740.5 | 443.0 | 3728.2 | 15.055046 | 2.3442e−51 | 1.00000 | N | 0.198621 | 0.118834 |
| DxxE | HhhH | 1237.9 | 835.4 | 5826.5 | 15.045687 | 2.4433e−51 | 1.00000 | N | 0.212460 | 0.143381 |
| ExxQ | HhhH | 1562.3 | 1108.4 | 7657.2 | 14.743542 | 2.1528e−49 | 1.00000 | N | 0.204030 | 0.144748 |
| GxxT | ChhH | 295.6 | 132.8 | 1720.0 | 14.702270 | 6.0666e−49 | 1.00000 | N | 0.171860 | 0.077226 |
| YxxE | HhhH | 584.6 | 335.1 | 3516.7 | 14.330678 | 1.0637e−46 | 1.00000 | N | 0.166235 | 0.095283 |
| NxxN | HhhH | 471.7 | 257.7 | 2067.4 | 14.251900 | 3.5119e−46 | 1.00000 | N | 0.228161 | 0.124630 |
| ExxR | HhhC | 380.1 | 197.9 | 1322.8 | 14.041511 | 7.4744e−45 | 1.00000 | N | 0.287345 | 0.149630 |
| QxxG | HhhC | 411.9 | 219.5 | 1555.2 | 14.009672 | 1.1350e−44 | 1.00000 | N | 0.264853 | 0.141160 |
| TxxR | HhhH | 765.0 | 482.3 | 4295.0 | 13.660714 | 1.2139e−42 | 1.00000 | N | 0.178114 | 0.112300 |
| DxxE | ChhH | 635.3 | 386.1 | 2788.7 | 13.662147 | 1.2445e−42 | 1.00000 | N | 0.227812 | 0.138458 |
| YxxQ | HhhH | 398.5 | 209.7 | 2527.7 | 13.617674 | 2.5739e−42 | 1.00000 | N | 0.157653 | 0.082949 |
| QxxN | HhhH | 542.7 | 316.8 | 2555.0 | 13.561238 | 5.1153e−42 | 1.00000 | N | 0.212407 | 0.123988 |
| DxxG | HhhH | 433.3 | 241.9 | 1739.4 | 13.261160 | 3.0841e−40 | 1.00000 | N | 0.249109 | 0.139082 |
| WxxE | HhhH | 321.8 | 161.2 | 1855.3 | 13.242353 | 4.3211e−40 | 1.00000 | N | 0.173449 | 0.086864 |
| ExxD | HhhH | 1269.7 | 909.8 | 6134.4 | 12.929975 | 1.9255e−38 | 1.00000 | N | 0.206980 | 0.148308 |
| HxxR | HhhH | 430.4 | 241.7 | 2107.3 | 12.903646 | 3.3433e−38 | 1.00000 | N | 0.204242 | 0.114677 |
| DxxL | HhhH | 1010.9 | 687.7 | 8629.3 | 12.846314 | 5.8301e−38 | 1.00000 | N | 0.117147 | 0.079696 |
| ExxG | HhcC | 744.6 | 484.9 | 3281.4 | 12.775335 | 1.5440e−37 | 1.00000 | N | 0.226915 | 0.147772 |
| ExxS | HhhH | 1097.9 | 768.3 | 6163.8 | 12.711229 | 3.2768e−37 | 1.00000 | N | 0.178121 | 0.124641 |
| QxxI | HhhH | 566.2 | 340.5 | 4971.5 | 12.671523 | 6.0800e−37 | 1.00000 | N | 0.113889 | 0.068494 |
| DxxA | ChhH | 593.4 | 365.5 | 3282.4 | 12.648212 | 8.1426e−37 | 1.00000 | N | 0.180804 | 0.111354 |
| SxxG | HhhC | 347.9 | 186.1 | 1537.7 | 12.646200 | 9.6469e−37 | 1.00000 | N | 0.226247 | 0.121053 |
| AxxD | HhhH | 1046.4 | 726.1 | 6872.9 | 12.566935 | 2.0561e−36 | 1.00000 | N | 0.152250 | 0.105654 |
| HxxN | HhhH | 260.9 | 127.1 | 1176.7 | 12.560981 | 3.1284e−36 | 1.00000 | N | 0.221722 | 0.108046 |
| DxxQ | HhhH | 723.6 | 471.1 | 3555.4 | 12.487682 | 5.9445e−36 | 1.00000 | N | 0.203521 | 0.132515 |
| KxxR | HhhH | 1092.2 | 773.5 | 5096.1 | 12.440642 | 1.0036e−35 | 1.00000 | N | 0.214321 | 0.151790 |
| KxxE | HhhH | 2359.1 | 1866.8 | 12050.7 | 12.393165 | 1.6647e−35 | 1.00000 | N | 0.195765 | 0.154916 |
| ExxY | HhhH | 594.3 | 368.6 | 4092.2 | 12.321576 | 4.8612e−35 | 1.00000 | N | 0.145228 | 0.090082 |
| DxxS | ChhH | 389.9 | 219.1 | 1996.9 | 12.233933 | 1.5902e−34 | 1.00000 | N | 0.195253 | 0.109696 |
| RxxE | HhhH | 293.5 | 153.3 | 1085.3 | 12.219943 | 2.0770e−34 | 1.00000 | N | 0.270432 | 0.141246 |
| NxxA | HhhH | 615.2 | 385.8 | 4642.0 | 12.194745 | 2.2966e−34 | 1.00000 | N | 0.132529 | 0.083118 |
| RxxG | HhcC | 659.6 | 428.8 | 2824.2 | 12.104920 | 6.8433e−34 | 1.00000 | N | 0.233553 | 0.151816 |
| NxxD | ChhH | 392.2 | 223.3 | 1771.2 | 12.091210 | 9.0805e−34 | 1.00000 | N | 0.221432 | 0.126069 |
| DxxQ | ChhH | 408.5 | 236.2 | 1714.9 | 12.072696 | 1.1263e−33 | 1.00000 | N | 0.238206 | 0.137738 |
| NxxL | ChhH | 281.7 | 142.8 | 1993.4 | 12.058417 | 1.4819e−33 | 1.00000 | N | 0.141316 | 0.071657 |
| HxxE | HhhH | 473.2 | 283.5 | 2266.1 | 12.043282 | 1.5453e−33 | 1.00000 | N | 0.208817 | 0.125115 |
| GxxE | ChhH | 439.0 | 257.5 | 2293.0 | 12.008640 | 2.3858e−33 | 1.00000 | N | 0.191452 | 0.112279 |
| NxxQ | HhhH | 424.5 | 248.0 | 2082.1 | 11.945249 | 5.1603e−33 | 1.00000 | N | 0.203882 | 0.119090 |
| PxxQ | ChhH | 241.0 | 119.4 | 891.4 | 11.960056 | 5.1935e−33 | 1.00000 | N | 0.270361 | 0.133930 |
| DxxI | HhhH | 616.4 | 390.7 | 5172.8 | 11.873778 | 1.1089e−32 | 1.00000 | N | 0.119162 | 0.075536 |
| DxxN | HhhH | 709.7 | 470.7 | 3574.6 | 11.821688 | 2.0234e−32 | 1.00000 | N | 0.198540 | 0.131680 |
| PxxQ | HhhH | 457.2 | 275.6 | 2183.2 | 11.694718 | 9.9071e−32 | 1.00000 | N | 0.209372 | 0.126244 |
| AxxS | HhhH | 758.2 | 505.5 | 6977.1 | 11.670720 | 1.1797e−31 | 1.00000 | N | 0.108670 | 0.072450 |
| PxxE | ChhH | 403.9 | 238.4 | 1641.8 | 11.591112 | 3.4386e−31 | 1.00000 | N | 0.246010 | 0.145223 |
| LxxR | HhhH | 1020.1 | 722.6 | 9691.9 | 11.504616 | 7.8213e−31 | 1.00000 | N | 0.105253 | 0.074557 |
| DxxD | ChhH | 374.5 | 215.7 | 1824.1 | 11.518567 | 8.0950e−31 | 1.00000 | N | 0.205307 | 0.118228 |
| NxxN | ChhH | 243.7 | 123.8 | 1030.3 | 11.485674 | 1.3538e−30 | 1.00000 | N | 0.236553 | 0.120178 |
| DxxR | ChhH | 424.4 | 255.7 | 1831.5 | 11.375735 | 4.0622e−30 | 1.00000 | N | 0.231723 | 0.139600 |
| NxxA | ChhH | 312.9 | 171.5 | 1945.5 | 11.304387 | 9.8336e−30 | 1.00000 | N | 0.160833 | 0.088165 |
| YxxR | HhhH | 419.1 | 249.3 | 2896.8 | 11.250980 | 1.6663e−29 | 1.00000 | N | 0.144677 | 0.086053 |
| DxxL | ChhH | 415.6 | 247.0 | 2867.7 | 11.221422 | 2.3305e−29 | 1.00000 | N | 0.144925 | 0.086134 |
| QxxY | HhhH | 320.8 | 177.7 | 2179.5 | 11.200574 | 3.1483e−29 | 1.00000 | N | 0.147190 | 0.081535 |
| DxxT | ChhH | 458.9 | 282.2 | 2519.2 | 11.161309 | 4.4957e−29 | 1.00000 | N | 0.182161 | 0.112025 |
| CxxC | HhhH | 91.2 | 31.4 | 345.5 | 11.183314 | 7.0327e−29 | 1.00000 | N | 0.263965 | 0.090959 |
| PxxL | HhhH | 608.9 | 395.6 | 6143.7 | 11.089911 | 9.3855e−29 | 1.00000 | N | 0.099110 | 0.064384 |
| DxxY | HhhH | 368.3 | 213.9 | 2333.5 | 11.075011 | 1.2369e−28 | 1.00000 | N | 0.157832 | 0.091673 |
| KxxG | HhcC | 745.6 | 514.8 | 3321.5 | 11.041005 | 1.5816e−28 | 1.00000 | N | 0.224526 | 0.154995 |
| RxxD | HhhH | 732.4 | 503.2 | 3530.9 | 11.036073 | 1.6724e−28 | 1.00000 | N | 0.207426 | 0.142503 |
| RxxG | EecC | 324.0 | 184.1 | 1428.3 | 11.048350 | 1.7317e−28 | 1.00000 | N | 0.226843 | 0.128887 |
| GxxS | ChhH | 183.5 | 85.6 | 1241.1 | 10.968621 | 5.0167e−28 | 1.00000 | N | 0.147853 | 0.068961 |
| DxxA | HhhH | 1133.7 | 834.4 | 8331.6 | 10.924825 | 5.3609e−28 | 1.00000 | N | 0.136072 | 0.100143 |
| RxxQ | ChhH | 123.0 | 50.4 | 388.2 | 10.969534 | 6.1545e−28 | 1.00000 | N | 0.316847 | 0.129758 |

TABLE 9

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxGK | CcCH | 167.7 | 26.9 | 711.5 | 27.705426 | 4.5759e−168 | 1.00000 | N | 0.235699 | 0.037747 |
| VxKS | CcHH | 52.9 | 6.6 | 219.9 | 18.362884 | 4.9087e−74 | 1.00000 | N | 0.240564 | 0.029847 |
| GxTT | ChHH | 83.7 | 17.2 | 346.9 | 16.454208 | 2.9941e−60 | 1.00000 | N | 0.241280 | 0.049554 |
| GxCW | CcHH | 29.6 | 0.4 | 45.0 | 46.718591 | 4.9102e−49 | 1.00000 | B | 0.657778 | 0.008761 |
| VxCK | EcCC | 42.0 | 3.1 | 60.9 | 22.843225 | 2.8454e−40 | 1.00000 | B | 0.689655 | 0.050241 |
| GxCW | EcHH | 23.1 | 0.3 | 37.8 | 42.803527 | 1.7396e−39 | 1.00000 | B | 0.611111 | 0.007573 |
| AxKT | CcHH | 36.8 | 2.4 | 104.5 | 22.244125 | 1.2660e−32 | 1.00000 | B | 0.352153 | 0.023376 |
| CxNG | CcCC | 44.4 | 9.3 | 177.5 | 11.796465 | 1.4799e−31 | 1.00000 | N | 0.250141 | 0.052558 |
| SxAE | ChHH | 122.9 | 48.4 | 589.8 | 11.168674 | 6.7314e−29 | 1.00000 | N | 0.208376 | 0.082117 |
| NxGK | CcCH | 34.8 | 3.3 | 86.9 | 17.596286 | 3.5249e−26 | 1.00000 | B | 0.400460 | 0.038281 |
| TxKT | CcHH | 39.5 | 4.3 | 154.6 | 17.143559 | 3.7891e−26 | 1.00000 | B | 0.255498 | 0.028007 |
| NxAC | EeCC | 27.0 | 2.0 | 50.4 | 18.153492 | 6.3631e−25 | 1.00000 | B | 0.535714 | 0.039237 |
| TxAE | ChHH | 127.2 | 56.2 | 609.9 | 9.932803 | 3.0165e−23 | 1.00000 | N | 0.208559 | 0.092199 |
| FxNS | ChHH | 27.7 | 2.3 | 55.4 | 16.958631 | 3.7819e−23 | 1.00000 | B | 0.500000 | 0.042157 |
| GxTN | CcHH | 32.2 | 7.1 | 72.4 | 9.871338 | 1.9381e−22 | 1.00000 | N | 0.444751 | 0.098713 |
| QxGK | CcCH | 29.0 | 3.4 | 42.7 | 14.374481 | 3.4874e−22 | 1.00000 | B | 0.679157 | 0.080540 |
| GxST | ChHH | 55.4 | 16.7 | 309.3 | 9.733730 | 3.7002e−22 | 1.00000 | N | 0.179114 | 0.054010 |
| TxAQ | ChHH | 65.5 | 22.0 | 303.2 | 9.611531 | 1.0400e−21 | 1.00000 | N | 0.216029 | 0.072705 |
| DxEG | HhHC | 38.2 | 9.8 | 91.3 | 9.586215 | 2.3137e−21 | 1.00000 | N | 0.418401 | 0.107564 |
| SxEE | ChHH | 251.6 | 144.3 | 1525.5 | 9.392189 | 4.4475e−21 | 1.00000 | N | 0.164930 | 0.094565 |
| SxKT | CcHH | 30.5 | 3.1 | 137.0 | 15.606960 | 5.0423e−21 | 1.00000 | B | 0.222628 | 0.022952 |
| NxRG | CeCC | 26.1 | 5.5 | 50.1 | 9.307237 | 5.3638e−20 | 1.00000 | N | 0.520958 | 0.109282 |
| KxDK | EeEE | 103.4 | 45.3 | 400.6 | 9.155613 | 5.5926e−20 | 1.00000 | N | 0.258113 | 0.113187 |
| KxTG | HhHC | 76.9 | 30.0 | 329.0 | 8.978773 | 3.2532e−19 | 1.00000 | N | 0.233739 | 0.091216 |
| SxTK | HcEE | 87.3 | 36.5 | 320.2 | 8.926379 | 4.8515e−19 | 1.00000 | N | 0.272642 | 0.114065 |
| FxGH | CcCC | 12.2 | 0.2 | 23.1 | 25.026094 | 1.0525e−18 | 1.00000 | B | 0.528139 | 0.010002 |
| GxTS | ChHH | 29.2 | 6.7 | 121.4 | 8.949970 | 1.0560e−18 | 1.00000 | N | 0.240527 | 0.055132 |
| CxAG | CcCC | 36.3 | 9.5 | 225.9 | 8.891002 | 1.3288e−18 | 1.00000 | N | 0.160691 | 0.042014 |
| GxGR | CcCH | 30.7 | 7.3 | 148.4 | 8.862278 | 2.1091e−18 | 1.00000 | N | 0.206873 | 0.049330 |
| TxVD | EeEE | 116.5 | 54.9 | 674.6 | 8.681155 | 3.6299e−18 | 1.00000 | N | 0.172746 | 0.081358 |
| PxWN | CeEC | 13.5 | 0.6 | 14.0 | 17.598010 | 4.8699e−18 | 1.00000 | B | 0.964286 | 0.040219 |
| AxGL | HcCC | 79.5 | 32.1 | 539.5 | 8.617327 | 7.5507e−18 | 1.00000 | N | 0.147359 | 0.059556 |
| SxYQ | ChHH | 24.4 | 5.2 | 78.1 | 8.742181 | 8.3452e−18 | 1.00000 | N | 0.312420 | 0.066298 |
| RxNG | EeCC | 51.7 | 17.5 | 171.1 | 8.620737 | 9.9272e−18 | 1.00000 | N | 0.302162 | 0.102376 |
| QxPN | HcHH | 26.8 | 6.3 | 56.5 | 8.705318 | 1.0034e−17 | 1.00000 | N | 0.474336 | 0.110806 |
| GxLA | CcCE | 25.1 | 2.7 | 98.2 | 13.717935 | 2.3659e−17 | 1.00000 | B | 0.255601 | 0.027844 |
| TxNR | ChHH | 29.0 | 4.4 | 76.1 | 12.133203 | 6.1385e−17 | 1.00000 | B | 0.381078 | 0.057443 |
| TxEE | ChHH | 243.4 | 147.4 | 1546.4 | 8.314461 | 6.6330e−17 | 1.00000 | N | 0.157398 | 0.095312 |
| NxAL | ChHH | 30.5 | 7.7 | 168.3 | 8.377216 | 1.2719e−16 | 1.00000 | N | 0.181224 | 0.045980 |
| TxTG | CcCC | 114.1 | 55.4 | 731.8 | 8.204551 | 2.0652e−16 | 1.00000 | N | 0.155917 | 0.075694 |
| SxKS | CcHH | 27.2 | 6.5 | 176.6 | 8.271558 | 3.4649e−16 | 1.00000 | N | 0.154020 | 0.036814 |
| WxGP | CcHH | 27.2 | 4.5 | 50.2 | 11.245730 | 5.9545e−16 | 1.00000 | B | 0.541833 | 0.089269 |
| GxSS | ChHH | 25.9 | 6.1 | 149.4 | 8.136343 | 1.0923e−15 | 1.00000 | N | 0.173360 | 0.041144 |
| SxAD | ChHH | 93.1 | 42.9 | 534.3 | 7.998864 | 1.1948e−15 | 1.00000 | N | 0.174247 | 0.080239 |
| PxNV | ChHH | 25.4 | 6.1 | 97.5 | 8.121634 | 1.2689e−15 | 1.00000 | N | 0.260513 | 0.062064 |
| QxTG | HhHC | 36.3 | 10.8 | 146.5 | 8.059476 | 1.3787e−15 | 1.00000 | N | 0.247782 | 0.073749 |
| NxCN | CcCC | 27.4 | 6.9 | 110.2 | 8.055912 | 1.9302e−15 | 1.00000 | N | 0.248639 | 0.062659 |
| GxGL | CcCH | 28.6 | 7.4 | 180.7 | 7.990101 | 3.0473e−15 | 1.00000 | N | 0.158273 | 0.040752 |
| QxNT | CeCC | 22.2 | 3.4 | 31.0 | 10.894909 | 3.4768e−15 | 1.00000 | B | 0.716129 | 0.108225 |
| GxGF | EcCE | 16.8 | 1.2 | 40.5 | 14.399043 | 3.7361e−15 | 1.00000 | B | 0.414815 | 0.029841 |
| TxEQ | ChHH | 131.0 | 69.3 | 722.9 | 7.799428 | 5.1196e−15 | 1.00000 | N | 0.181215 | 0.095827 |
| ExLG | HhHC | 117.4 | 59.7 | 783.8 | 7.773841 | 6.4656e−15 | 1.00000 | N | 0.149783 | 0.076139 |
| MxIF | CcHH | 24.6 | 3.6 | 56.8 | 11.457873 | 6.4773e−15 | 1.00000 | B | 0.433099 | 0.063193 |
| LxHA | CcEE | 11.8 | 0.4 | 33.3 | 19.335145 | 7.4581e−15 | 1.00000 | B | 0.354354 | 0.010636 |
| MxLC | EeCC | 9.0 | 0.2 | 15.1 | 22.286623 | 8.2126e−15 | 1.00000 | B | 0.596026 | 0.010533 |
| SxLP | HhCC | 41.8 | 13.8 | 235.1 | 7.791006 | 9.8874e−15 | 1.00000 | N | 0.177797 | 0.058524 |
| SxKV | CeEE | 74.8 | 32.8 | 361.7 | 7.687742 | 1.5248e−14 | 1.00000 | N | 0.206801 | 0.090709 |
| YxTM | CcCE | 19.6 | 2.1 | 43.7 | 12.252047 | 2.0037e−14 | 1.00000 | B | 0.448513 | 0.048882 |
| DxCQ | EcCC | 15.9 | 1.0 | 105.6 | 14.568386 | 3.6015e−14 | 1.00000 | B | 0.150568 | 0.009939 |
| LxDW | EcCC | 10.1 | 0.3 | 23.0 | 18.614550 | 6.7635e−14 | 1.00000 | B | 0.439130 | 0.012246 |
| RxGL | HhCC | 42.9 | 15.0 | 220.2 | 7.477473 | 1.0395e−13 | 1.00000 | N | 0.194823 | 0.067983 |
| SxEQ | ChHH | 106.6 | 54.0 | 926.8 | 7.379054 | 1.3464e−13 | 1.00000 | N | 0.115019 | 0.058249 |
| VxKT | CcHH | 25.3 | 3.9 | 163.9 | 10.987962 | 1.5771e−13 | 1.00000 | B | 0.154362 | 0.023729 |
| YxSG | HcHC | 28.3 | 8.0 | 122.7 | 7.457246 | 1.7456e−13 | 1.00000 | N | 0.230644 | 0.064853 |
| NxGY | EcCC | 21.7 | 3.1 | 58.1 | 10.941103 | 2.7368e−13 | 1.00000 | B | 0.373494 | 0.052720 |
| GxFM | CcCH | 10.0 | 0.5 | 10.7 | 13.642568 | 3.2977e−13 | 1.00000 | B | 0.934579 | 0.047496 |
| SxMS | CcEE | 14.9 | 1.1 | 51.5 | 13.353266 | 3.9684e−13 | 1.00000 | B | 0.289320 | 0.021211 |
| YxGD | EcCC | 25.4 | 6.8 | 119.1 | 7.343589 | 4.4620e−13 | 1.00000 | N | 0.213266 | 0.057113 |
| NxLP | HhCC | 31.4 | 9.5 | 153.2 | 7.304107 | 4.7698e−13 | 1.00000 | N | 0.204961 | 0.062314 |
| NxED | ChHH | 68.8 | 30.8 | 317.4 | 7.204843 | 5.8007e−13 | 1.00000 | N | 0.216761 | 0.097047 |
| SxDE | ChHH | 97.5 | 49.7 | 519.2 | 7.121477 | 9.1460e−13 | 1.00000 | N | 0.187789 | 0.095803 |
| YxGS | EcCC | 36.1 | 12.1 | 183.5 | 7.135684 | 1.4043e−12 | 1.00000 | N | 0.197160 | 0.066120 |
| RxHG | HhHC | 25.6 | 7.2 | 82.9 | 7.166051 | 1.5713e−12 | 1.00000 | N | 0.308806 | 0.086994 |
| AxGK | CcCH | 26.4 | 7.4 | 177.4 | 7.117663 | 2.1019e−12 | 1.00000 | N | 0.148816 | 0.041830 |
| SxSE | ChHH | 61.7 | 26.9 | 315.1 | 7.001886 | 2.5790e−12 | 1.00000 | N | 0.195811 | 0.085508 |
| DxVT | EeEE | 24.9 | 6.8 | 171.0 | 7.088115 | 2.7435e−12 | 1.00000 | N | 0.145614 | 0.039734 |
| PxKC | CcCH | 12.3 | 1.3 | 12.5 | 10.266594 | 3.6601e−12 | 1.00000 | B | 0.984000 | 0.102657 |

TABLE 9-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| KxLG | HhHC | 102.4 | 53.8 | 672.1 | 6.913764 | 3.8864e−12 | 1.00000 | N | 0.152358 | 0.080006 |
| RxSE | EeCC | 29.1 | 8.9 | 141.3 | 7.008188 | 4.1037e−12 | 1.00000 | N | 0.205945 | 0.062855 |
| TxNI | EeCC | 15.3 | 1.7 | 25.9 | 10.648995 | 6.3319e−12 | 1.00000 | B | 0.590734 | 0.067123 |
| AxGF | HcCC | 33.5 | 11.1 | 222.8 | 6.917099 | 6.7617e−12 | 1.00000 | N | 0.150359 | 0.049674 |
| PxSQ | ChHH | 31.3 | 10.2 | 111.0 | 6.920163 | 7.0916e−12 | 1.00000 | N | 0.281982 | 0.092073 |
| ExLP | HhCC | 42.2 | 15.8 | 295.8 | 6.839588 | 9.7186e−12 | 1.00000 | N | 0.142664 | 0.053319 |
| KxHG | HhCC | 42.9 | 16.6 | 163.8 | 6.820623 | 1.1077e−11 | 1.00000 | N | 0.261905 | 0.101187 |
| GxGR | CcHH | 20.4 | 3.0 | 109.2 | 10.222967 | 1.2503e−11 | 1.00000 | B | 0.186813 | 0.027325 |
| VxHG | CcEE | 7.8 | 0.1 | 17.8 | 19.977321 | 1.5310e−11 | 1.00000 | B | 0.438202 | 0.008312 |
| DxAS | ChHH | 45.9 | 18.2 | 275.4 | 6.736084 | 1.8618e−11 | 1.00000 | N | 0.166667 | 0.065934 |
| ExFG | HhHC | 57.0 | 24.7 | 365.9 | 6.717061 | 1.8836e−11 | 1.00000 | N | 0.155780 | 0.067613 |
| ExSG | HhHC | 34.0 | 11.8 | 154.5 | 6.751139 | 2.0640e−11 | 1.00000 | N | 0.220065 | 0.076071 |
| RxTG | HhHC | 45.1 | 17.9 | 213.7 | 6.711082 | 2.2341e−11 | 1.00000 | N | 0.211044 | 0.083822 |
| ExTG | HhHC | 52.2 | 22.0 | 309.4 | 6.677412 | 2.5699e−11 | 1.00000 | N | 0.168714 | 0.071133 |
| NxAQ | ChHH | 32.7 | 11.2 | 137.8 | 6.713106 | 2.7429e−11 | 1.00000 | N | 0.237300 | 0.081146 |
| SxQE | ChHH | 54.8 | 23.8 | 271.3 | 6.647848 | 3.0642e−11 | 1.00000 | N | 0.201990 | 0.087780 |
| CxSC | CcCH | 7.0 | 0.1 | 36.8 | 20.082842 | 3.1318e−11 | 1.00000 | B | 0.190217 | 0.003201 |
| FxTN | EcCC | 19.5 | 3.0 | 66.8 | 9.782338 | 3.5580e−11 | 1.00000 | B | 0.291916 | 0.044669 |
| TxNG | EeCC | 49.7 | 20.7 | 275.2 | 6.622482 | 3.8018e−11 | 1.00000 | N | 0.180596 | 0.075273 |
| PxDQ | ChHH | 43.8 | 17.5 | 180.6 | 6.602266 | 4.6907e−11 | 1.00000 | N | 0.242525 | 0.097075 |
| QxVI | CcCC | 24.5 | 7.2 | 107.7 | 6.666417 | 4.7835e−11 | 1.00000 | N | 0.227484 | 0.066942 |
| ExGG | EeCC | 45.4 | 18.2 | 306.7 | 6.559515 | 6.0218e−11 | 1.00000 | N | 0.148027 | 0.059455 |

TABLE 10

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GKxT | CHhH | 137.0 | 18.6 | 556.5 | 27.928770 | 1.6042e−170 | 1.00000 | N | 0.246181 | 0.033414 |
| GKxS | CHhH | 56.2 | 5.0 | 184.9 | 23.104150 | 3.8172e−116 | 1.00000 | N | 0.303948 | 0.027261 |
| TGxT | CChH | 69.6 | 9.6 | 241.3 | 19.717926 | 1.9252e−85 | 1.00000 | N | 0.288438 | 0.039924 |
| VGxS | CChH | 50.5 | 6.3 | 209.2 | 17.879802 | 3.1232e−70 | 1.00000 | N | 0.241396 | 0.030118 |
| NKxD | ECcC | 74.1 | 12.7 | 233.0 | 17.719652 | 1.9024e−69 | 1.00000 | N | 0.318026 | 0.054503 |
| GSxK | CCcH | 46.5 | 6.2 | 194.2 | 16.436360 | 1.4881e−59 | 1.00000 | N | 0.239444 | 0.031966 |
| GVxK | CCcH | 55.3 | 9.0 | 278.3 | 15.716574 | 8.3454e−55 | 1.00000 | N | 0.198706 | 0.032256 |
| CKxC | CCcC | 51.5 | 11.1 | 173.9 | 12.558736 | 1.2519e−35 | 1.00000 | N | 0.296147 | 0.063651 |
| GTxK | CCcH | 35.3 | 5.8 | 178.9 | 12.475785 | 7.0287e−35 | 1.00000 | N | 0.197317 | 0.032332 |
| GFxN | CChH | 31.2 | 5.6 | 56.9 | 11.416464 | 2.1905e−29 | 1.00000 | N | 0.548330 | 0.098116 |
| WCxP | CChH | 33.3 | 2.6 | 62.5 | 19.373109 | 4.2055e−29 | 1.00000 | B | 0.532800 | 0.041887 |
| FTxS | CChH | 27.7 | 2.2 | 52.5 | 17.490092 | 6.0171e−24 | 1.00000 | B | 0.527619 | 0.042219 |
| NVxC | EEcC | 26.5 | 1.9 | 52.2 | 17.922628 | 8.5115e−24 | 1.00000 | B | 0.507663 | 0.037341 |
| VAxK | ECcC | 33.3 | 7.2 | 90.1 | 10.147731 | 1.2188e−23 | 1.00000 | N | 0.369589 | 0.079833 |
| SGxT | CChH | 34.7 | 7.7 | 211.7 | 9.940448 | 8.6460e−23 | 1.00000 | N | 0.163911 | 0.036237 |
| AGxT | CChH | 36.4 | 4.4 | 143.7 | 15.434531 | 9.7685e−23 | 1.00000 | B | 0.253305 | 0.030811 |
| GGxM | CCcH | 30.4 | 3.0 | 94.6 | 16.207156 | 2.5281e−22 | 1.00000 | B | 0.321353 | 0.031282 |
| SGxS | CChH | 27.3 | 5.3 | 185.2 | 9.755693 | 7.5361e−22 | 1.00000 | N | 0.147408 | 0.028376 |
| ERxG | HHcC | 76.1 | 28.0 | 265.7 | 9.603856 | 1.0100e−21 | 1.00000 | N | 0.286413 | 0.105454 |
| DSxE | CChH | 66.0 | 22.6 | 239.7 | 9.582583 | 1.3711e−21 | 1.00000 | N | 0.275344 | 0.094387 |
| RExG | HHhC | 92.3 | 37.7 | 353.8 | 9.418390 | 5.1848e−21 | 1.00000 | N | 0.260882 | 0.106451 |
| DSxT | EEeE | 32.3 | 7.5 | 89.0 | 9.470465 | 8.5068e−21 | 1.00000 | N | 0.362921 | 0.084184 |
| QFxT | CEcC | 21.3 | 1.6 | 29.7 | 16.061616 | 9.1250e−21 | 1.00000 | B | 0.717172 | 0.053568 |
| GAxK | CCcH | 35.5 | 5.0 | 135.7 | 13.978985 | 2.4411e−20 | 1.00000 | B | 0.261606 | 0.036517 |
| VGxT | CChH | 29.1 | 6.4 | 179.3 | 9.116224 | 2.4335e−19 | 1.00000 | N | 0.162298 | 0.035804 |
| NQxP | HHcH | 28.5 | 6.6 | 58.0 | 9.017809 | 6.1701e−19 | 1.00000 | N | 0.491379 | 0.114435 |
| TKxD | EEeE | 103.5 | 46.7 | 416.7 | 8.823218 | 1.1095e−18 | 1.00000 | N | 0.248380 | 0.112045 |
| QAxG | HHcC | 58.1 | 20.4 | 220.9 | 8.766703 | 2.5643e−18 | 1.00000 | N | 0.263015 | 0.092292 |
| KVxE | EEeE | 129.0 | 63.4 | 665.5 | 8.662445 | 4.1119e−18 | 1.00000 | N | 0.193839 | 0.095260 |
| IDxS | ECcE | 41.4 | 12.0 | 221.9 | 8.712627 | 5.4346e−18 | 1.00000 | N | 0.186571 | 0.054175 |
| STxV | CEeE | 79.7 | 33.6 | 368.4 | 8.334380 | 8.3322e−17 | 1.00000 | N | 0.216341 | 0.091281 |
| FYxM | CCcE | 1.0 | 0.1 | 1.0 | 3.846944 | 1.0400e−16 | 1.00000 | B | 1.000000 | 0.063295 |
| NIxM | HCcC | 1.0 | 0.0 | 1.0 | 4.415241 | 1.0561e−16 | 1.00000 | B | 1.000000 | 0.048794 |
| PTxN | CEeC | 15.5 | 1.1 | 17.1 | 14.132918 | 1.0977e−16 | 1.00000 | B | 0.906433 | 0.064841 |
| NKxG | HHhC | 32.2 | 8.7 | 87.3 | 8.377682 | 1.2095e−16 | 1.00000 | N | 0.368843 | 0.099933 |
| NKxD | EChH | 24.2 | 5.3 | 121.7 | 8.342068 | 2.3144e−16 | 1.00000 | N | 0.198850 | 0.043910 |
| YAxG | HHcC | 30.2 | 7.8 | 110.3 | 8.294939 | 2.5405e−16 | 1.00000 | N | 0.273799 | 0.070980 |
| YSxM | CCcE | 23.7 | 2.8 | 61.6 | 12.840494 | 3.5944e−16 | 1.00000 | B | 0.384740 | 0.045127 |
| ACxN | CCcC | 23.9 | 5.4 | 105.8 | 8.125941 | 1.3307e−15 | 1.00000 | N | 0.225898 | 0.051421 |
| RRxG | HHhC | 58.0 | 22.3 | 215.4 | 7.997367 | 1.5668e−15 | 1.00000 | N | 0.269266 | 0.103372 |
| FPxH | CCcH | 12.5 | 0.5 | 22.2 | 17.814824 | 2.2978e−15 | 1.00000 | B | 0.563063 | 0.020995 |
| VSxG | EEeC | 28.5 | 7.3 | 361.1 | 7.916574 | 5.3875e−15 | 1.00000 | N | 0.078926 | 0.020248 |
| RAxG | HHcC | 86.6 | 40.4 | 412.0 | 7.653312 | 1.8592e−14 | 1.00000 | N | 0.210194 | 0.098060 |
| KDxG | HHhC | 61.6 | 25.2 | 236.0 | 7.660531 | 2.0910e−14 | 1.00000 | N | 0.261017 | 0.106924 |
| SSxK | HCeE | 57.9 | 23.2 | 198.2 | 7.653307 | 2.2980e−14 | 1.00000 | N | 0.292129 | 0.117242 |
| RRxG | HHcC | 56.3 | 22.3 | 211.9 | 7.619259 | 3.0185e−14 | 1.00000 | N | 0.265691 | 0.105141 |

TABLE 10-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| KKxG | HHhC | 87.7 | 41.5 | 381.6 | 7.588969 | 3.0299e-14 | 1.00000 | N | 0.229822 | 0.108834 |
| GSxW | EChH | 11.0 | 0.3 | 38.1 | 18.116766 | 3.7547e-14 | 1.00000 | B | 0.288714 | 0.009156 |
| GLxP | CCcH | 48.9 | 17.8 | 319.3 | 7.570949 | 4.6990e-14 | 1.00000 | N | 0.153148 | 0.055852 |
| KGxG | CChH | 21.6 | 5.0 | 71.7 | 7.659772 | 5.4871e-14 | 1.00000 | N | 0.301255 | 0.070178 |
| KQxT | CEeE | 26.1 | 4.9 | 50.9 | 10.135942 | 5.6397e-14 | 1.00000 | B | 0.512770 | 0.095404 |
| ARxP | HHcC | 39.6 | 13.4 | 140.5 | 7.511607 | 8.6527e-14 | 1.00000 | N | 0.281851 | 0.095553 |
| ETxS | ECcC | 29.2 | 8.4 | 99.1 | 7.526295 | 1.0238e-13 | 1.00000 | N | 0.294652 | 0.084439 |
| DKxG | HHhC | 59.5 | 24.9 | 228.9 | 7.356353 | 2.0816e-13 | 1.00000 | N | 0.259939 | 0.108634 |
| KPxY | CCcC | 42.7 | 15.2 | 188.2 | 7.350314 | 2.6651e-13 | 1.00000 | N | 0.226886 | 0.080837 |
| QTxK | CCcH | 17.8 | 2.2 | 26.3 | 10.850825 | 3.1717e-13 | 1.00000 | B | 0.676806 | 0.085419 |
| RSxG | HHcC | 54.3 | 22.0 | 224.4 | 7.250022 | 4.7424e-13 | 1.00000 | N | 0.241979 | 0.098051 |
| KMxF | CCcC | 23.1 | 6.0 | 83.2 | 7.217699 | 1.2237e-12 | 1.00000 | N | 0.277644 | 0.072479 |
| RKxG | HHhC | 59.6 | 25.6 | 254.0 | 7.098040 | 1.3380e-12 | 1.00000 | N | 0.234646 | 0.100650 |
| EExG | HHhC | 98.4 | 50.6 | 520.0 | 7.065914 | 1.3554e-12 | 1.00000 | N | 0.189203 | 0.097369 |
| AAxG | HHhC | 75.4 | 35.0 | 497.1 | 7.073599 | 1.4144e-12 | 1.00000 | N | 0.151680 | 0.070477 |
| LSxE | CChH | 112.6 | 60.1 | 832.4 | 7.032831 | 1.6319e-12 | 1.00000 | N | 0.135272 | 0.072187 |
| KAxG | HHcC | 86.7 | 43.1 | 434.8 | 7.007685 | 2.1431e-12 | 1.00000 | N | 0.199402 | 0.099021 |
| MNxF | CChH | 25.2 | 4.9 | 62.4 | 9.506941 | 2.2013e-12 | 1.00000 | B | 0.403846 | 0.079074 |
| LTxW | ECcC | 10.1 | 0.4 | 19.7 | 15.073737 | 2.2502e-12 | 1.00000 | B | 0.512690 | 0.021385 |
| NPxE | CCcH | 23.8 | 6.4 | 92.8 | 7.124827 | 2.2574e-12 | 1.00000 | N | 0.256466 | 0.069004 |
| WLxV | EEcC | 11.0 | 0.8 | 12.3 | 11.619322 | 2.4161e-12 | 1.00000 | B | 0.894309 | 0.066848 |
| GVxF | CEeE | 20.8 | 5.1 | 180.9 | 7.100474 | 3.1004e-12 | 1.00000 | N | 0.114981 | 0.027956 |
| SAxG | HHhC | 37.8 | 13.3 | 158.5 | 7.005915 | 3.3764e-12 | 1.00000 | N | 0.238486 | 0.084068 |
| CGxC | CEcH | 10.3 | 0.4 | 33.8 | 15.665276 | 3.9680e-12 | 1.00000 | B | 0.304734 | 0.011950 |
| GSxW | CChH | 13.8 | 1.0 | 55.6 | 12.942109 | 4.0102e-12 | 1.00000 | B | 0.248201 | 0.017924 |
| KNxA | EEeC | 20.4 | 5.2 | 50.6 | 7.054783 | 4.4588e-12 | 1.00000 | N | 0.403162 | 0.102437 |
| EAxG | HHcC | 82.7 | 40.7 | 436.1 | 6.903283 | 4.5200e-12 | 1.00000 | N | 0.189635 | 0.093429 |
| GKxA | CHhH | 32.0 | 10.2 | 237.0 | 6.946622 | 5.7267e-12 | 1.00000 | N | 0.135021 | 0.043241 |
| QKxG | HHhC | 50.3 | 20.7 | 190.7 | 6.898030 | 5.9432e-12 | 1.00000 | N | 0.263765 | 0.108445 |
| FMxQ | CEeE | 13.1 | 0.9 | 62.3 | 12.683560 | 7.8246e-12 | 1.00000 | B | 0.210273 | 0.014993 |
| LAxG | HHcC | 73.6 | 34.7 | 547.8 | 6.815209 | 8.6277e-12 | 1.00000 | N | 0.134356 | 0.063400 |
| FNxN | ECcC | 20.7 | 5.2 | 107.5 | 6.950636 | 8.7080e-12 | 1.00000 | N | 0.192558 | 0.048520 |
| TQxG | HHcC | 23.6 | 6.7 | 73.0 | 6.857650 | 1.4179e-11 | 1.00000 | N | 0.323288 | 0.091676 |
| TWxI | EEcC | 12.3 | 1.2 | 15.1 | 10.555052 | 1.8885e-11 | 1.00000 | B | 0.814570 | 0.079552 |
| WGxG | ECcC | 39.1 | 14.1 | 669.1 | 6.742288 | 1.9532e-11 | 1.00000 | N | 0.058437 | 0.021034 |
| DRxG | HHhC | 37.3 | 13.7 | 145.5 | 6.710008 | 2.5502e-11 | 1.00000 | N | 0.256357 | 0.094011 |
| GDxT | CCcE | 34.9 | 12.3 | 154.9 | 6.715037 | 2.5763e-11 | 1.00000 | N | 0.225307 | 0.079419 |
| PFxA | CCcH | 20.8 | 3.5 | 66.6 | 9.476040 | 3.8082e-11 | 1.00000 | B | 0.312312 | 0.052751 |
| DHxK | CCcH | 14.5 | 1.4 | 46.3 | 11.115290 | 3.8920e-11 | 1.00000 | B | 0.313175 | 0.030826 |
| ISxE | CChH | 56.6 | 24.8 | 386.1 | 6.605482 | 3.9718e-11 | 1.00000 | N | 0.146594 | 0.064198 |
| RMxT | HHcC | 13.8 | 1.4 | 24.9 | 10.680289 | 4.2758e-11 | 1.00000 | B | 0.554217 | 0.057195 |
| ANxP | HHcC | 30.6 | 10.3 | 110.0 | 6.640679 | 4.6760e-11 | 1.00000 | N | 0.278182 | 0.093685 |
| LSxG | HHcC | 39.7 | 15.0 | 242.9 | 6.598851 | 5.0502e-11 | 1.00000 | N | 0.163442 | 0.061625 |
| GLxR | CHhH | 21.8 | 5.9 | 145.6 | 6.672827 | 5.1373e-11 | 1.00000 | N | 0.149725 | 0.040593 |
| YWxD | CCeE | 6.6 | 0.1 | 6.5 | 18.333825 | 6.7702e-11 | 1.00000 | B | 1.015385 | 0.018971 |
| DAxG | HHhC | 38.6 | 14.7 | 177.7 | 6.514124 | 8.9759e-11 | 1.00000 | N | 0.217220 | 0.082658 |
| QGxG | CChH | 17.2 | 2.5 | 46.0 | 9.594800 | 9.0059e-11 | 1.00000 | B | 0.373913 | 0.054045 |
| EGxT | ECcE | 26.5 | 8.5 | 78.0 | 6.552315 | 9.4222e-11 | 1.00000 | N | 0.339744 | 0.108760 |
| SGxW | CCcE | 20.7 | 5.6 | 91.2 | 6.551699 | 1.1925e-10 | 1.00000 | N | 0.226974 | 0.061790 |
| KExG | HHhC | 110.3 | 62.5 | 581.6 | 6.398256 | 1.2154e-10 | 1.00000 | N | 0.189649 | 0.107478 |
| QExG | HHhC | 44.7 | 18.4 | 194.8 | 6.446972 | 1.2707e-10 | 1.00000 | N | 0.229466 | 0.094406 |
| KSxW | CChH | 17.5 | 2.5 | 59.4 | 9.591293 | 1.6500e-10 | 1.00000 | B | 0.294613 | 0.042780 |
| CGxC | CCcH | 9.9 | 0.5 | 42.7 | 13.508852 | 1.7531e-10 | 1.00000 | B | 0.231850 | 0.011494 |

TABLE 11

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GKTT | CHHH | 76.5 | 5.5 | 253.6 | 30.574180 | 9.6042e-203 | 1.00000 | N | 0.301656 | 0.021730 |
| GKST | CHHH | 46.3 | 5.3 | 197.6 | 18.047241 | 2.1757e-71 | 1.00000 | N | 0.234312 | 0.026836 |
| VGKS | CCHH | 47.9 | 1.7 | 155.8 | 35.415804 | 7.1871e-54 | 1.00000 | B | 0.307445 | 0.011035 |
| AGKT | CCHH | 35.5 | 0.7 | 86.1 | 40.746053 | 2.0004e-49 | 1.00000 | B | 0.412311 | 0.008528 |
| GVGK | CCCH | 47.2 | 2.5 | 185.6 | 28.170650 | 9.8957e-45 | 1.00000 | B | 0.254310 | 0.013725 |
| GSGK | CCCH | 41.1 | 2.5 | 156.8 | 24.822233 | 1.5821e-37 | 1.00000 | B | 0.262117 | 0.015699 |
| TGKT | CCHH | 39.3 | 2.7 | 129.9 | 22.607690 | 4.6581e-34 | 1.00000 | B | 0.302540 | 0.020625 |
| VACK | ECCC | 33.2 | 2.4 | 45.0 | 20.373654 | 1.4230e-32 | 1.00000 | B | 0.737778 | 0.053619 |
| CSAG | CCCC | 18.6 | 0.2 | 56.3 | 45.155914 | 2.7647e-32 | 1.00000 | B | 0.330373 | 0.002969 |
| KVDK | EEEE | 99.7 | 35.9 | 374.1 | 11.193395 | 5.8880e-29 | 1.00000 | N | 0.266506 | 0.096012 |
| TKVD | EEEE | 98.5 | 36.0 | 385.6 | 10.933259 | 1.0444e-27 | 1.00000 | N | 0.255446 | 0.093416 |
| GAGK | CCCH | 28.8 | 1.8 | 99.9 | 20.625737 | 2.2129e-26 | 1.00000 | B | 0.288288 | 0.017523 |
| CKNG | CCCC | 32.8 | 3.1 | 60.3 | 17.224893 | 5.4973e-26 | 1.00000 | B | 0.543947 | 0.051900 |
| STKV | CEEE | 69.5 | 22.3 | 234.9 | 10.494679 | 1.4747e-25 | 1.00000 | N | 0.295871 | 0.095048 |
| GSCW | CCHH | 12.8 | 0.1 | 33.8 | 46.433544 | 1.4522e-24 | 1.00000 | B | 0.378698 | 0.002227 |

TABLE 11-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| NVAC | EECC | 26.5 | 1.9 | 49.4 | 18.344959 | 1.9069e-24 | 1.00000 | B | 0.536437 | 0.037918 |
| GKTS | CHHH | 25.4 | 1.6 | 64.9 | 19.094604 | 8.3481e-24 | 1.00000 | B | 0.391371 | 0.024554 |
| SGKT | CCHH | 28.0 | 2.2 | 126.7 | 17.503774 | 1.0663e-22 | 1.00000 | B | 0.220994 | 0.017439 |
| GTGK | CCCH | 28.6 | 2.3 | 128.1 | 17.567876 | 1.1598e-22 | 1.00000 | B | 0.223263 | 0.017834 |
| FTNS | CHHH | 25.7 | 2.1 | 47.2 | 16.829282 | 2.2403e-22 | 1.00000 | B | 0.544492 | 0.043704 |
| GSCW | ECHH | 11.0 | 0.1 | 27.3 | 39.303420 | 1.3941e-21 | 1.00000 | B | 0.402930 | 0.002837 |
| SGKS | CCHH | 21.9 | 1.2 | 111.0 | 19.363958 | 3.2639e-21 | 1.00000 | B | 0.197297 | 0.010445 |
| VGKT | CCHH | 25.3 | 1.9 | 136.0 | 17.189134 | 7.3292e-21 | 1.00000 | B | 0.186029 | 0.013839 |
| DKEG | HHHC | 26.2 | 5.5 | 57.6 | 9.268980 | 7.4842e-20 | 1.00000 | N | 0.454861 | 0.095656 |
| FPGH | CCCH | 11.5 | 0.2 | 16.2 | 28.669589 | 1.9821e-19 | 1.00000 | B | 0.709877 | 0.009756 |
| WCGP | CCHH | 23.2 | 2.1 | 48.1 | 14.990162 | 3.7261e-19 | 1.00000 | B | 0.482328 | 0.043149 |
| GFTN | CCHH | 28.4 | 4.0 | 44.3 | 12.702991 | 6.0926e-19 | 1.00000 | B | 0.641084 | 0.091314 |
| LTDW | ECCC | 10.1 | 0.1 | 11.0 | 26.776988 | 1.1021e-18 | 1.00000 | B | 0.918182 | 0.012740 |
| PGPP | CCCC | 27.7 | 3.6 | 50.4 | 13.137686 | 1.2393e-18 | 1.00000 | B | 0.549603 | 0.071817 |
| QFNT | CECC | 19.8 | 1.6 | 28.2 | 15.038708 | 1.4634e-18 | 1.00000 | B | 0.702128 | 0.055230 |
| TQTG | CCCC | 23.0 | 2.4 | 39.9 | 13.827921 | 1.8451e-18 | 1.00000 | B | 0.576441 | 0.059320 |
| LNHA | CCEE | 11.1 | 0.2 | 20.0 | 25.694482 | 5.0337e-18 | 1.00000 | B | 0.555000 | 0.009110 |
| GKSS | CHHH | 19.2 | 1.2 | 65.2 | 16.561873 | 5.3468e-18 | 1.00000 | B | 0.294479 | 0.018451 |
| QHFK | EEEE | 15.5 | 1.0 | 16.0 | 14.980105 | 6.5038e-18 | 1.00000 | B | 0.968750 | 0.062464 |
| SSTK | HCEE | 54.6 | 18.9 | 198.1 | 8.640682 | 7.9973e-18 | 1.00000 | N | 0.275618 | 0.095330 |
| RWNR | CCCH | 2.0 | 0.2 | 2.0 | 4.893270 | 3.1595e-17 | 1.00000 | B | 1.000000 | 0.077089 |
| NVGK | CCCH | 13.5 | 0.4 | 31.0 | 20.335166 | 4.2581e-17 | 1.00000 | B | 0.435484 | 0.013530 |
| ACKN | CCCC | 22.1 | 2.3 | 44.0 | 13.351970 | 4.5720e-17 | 1.00000 | B | 0.502273 | 0.052665 |
| NAGK | CCCH | 9.8 | 0.1 | 18.7 | 30.350479 | 6.7477e-17 | 1.00000 | B | 0.524064 | 0.005489 |
| HTFI | ECCC | 1.0 | 0.1 | 1.0 | 3.375835 | 1.0207e-16 | 1.00000 | B | 1.000000 | 0.080669 |
| EAHV | CCCE | 1.0 | 0.1 | 1.0 | 3.921514 | 1.0424e-16 | 1.00000 | B | 1.000000 | 0.061056 |
| FADK | EEEC | 1.5 | 0.1 | 1.0 | 3.999796 | 1.0449e-16 | 1.00000 | B | 1.500000 | 0.058829 |
| FHIS | HCCC | 1.8 | 0.1 | 1.0 | 4.020228 | 1.0455e-16 | 1.00000 | B | 1.800000 | 0.058267 |
| ADKL | EECC | 1.7 | 0.1 | 1.0 | 4.062022 | 1.0468e-16 | 1.00000 | B | 1.700000 | 0.057143 |
| AGKS | CCHH | 14.6 | 0.6 | 40.6 | 18.684159 | 1.0527e-16 | 1.00000 | B | 0.359606 | 0.014083 |
| TFGK | ECCH | 1.0 | 0.0 | 1.0 | 4.763663 | 1.0634e-16 | 1.00000 | B | 1.000000 | 0.042207 |
| ANHI | HHCC | 1.0 | 0.0 | 1.0 | 4.967051 | 1.0670e-16 | 1.00000 | B | 1.000000 | 0.038954 |
| YIKI | EECC | 1.5 | 0.0 | 1.0 | 5.722446 | 1.0773e-16 | 1.00000 | B | 1.500000 | 0.029633 |
| AGMD | CCEC | 1.3 | 0.0 | 1.0 | 6.850790 | 1.0871e-16 | 1.00000 | B | 1.300000 | 0.020862 |
| LFLE | CHHH | 1.0 | 0.0 | 1.0 | 7.222429 | 1.0893e-16 | 1.00000 | B | 1.000000 | 0.018810 |
| VATS | ECHH | 1.5 | 0.0 | 1.0 | 19.687447 | 1.1074e-16 | 1.00000 | B | 1.500000 | 0.002573 |
| GLGF | ECCE | 8.5 | 0.1 | 11.4 | 32.451180 | 2.0417e-16 | 1.00000 | B | 0.745614 | 0.005958 |
| QEVI | CCCC | 17.0 | 1.4 | 24.7 | 13.695861 | 2.5094e-16 | 1.00000 | B | 0.688259 | 0.055787 |
| MELC | EECC | 9.0 | 0.1 | 12.1 | 25.465608 | 2.7631e-16 | 1.00000 | B | 0.743802 | 0.010146 |
| MDSS | ECCC | 14.9 | 0.7 | 43.2 | 17.357420 | 4.1795e-16 | 1.00000 | B | 0.344907 | 0.015781 |
| QTGK | CCCH | 16.3 | 1.5 | 18.2 | 12.705645 | 4.9345e-16 | 1.00000 | B | 0.895604 | 0.081365 |
| PSVY | CEEE | 17.5 | 1.1 | 268.7 | 15.823536 | 1.2792e-15 | 1.00000 | B | 0.065128 | 0.004023 |
| TPNR | CHHH | 22.0 | 2.6 | 54.2 | 12.385370 | 1.5783e-15 | 1.00000 | B | 0.405904 | 0.047623 |
| KPLY | CCCC | 17.3 | 1.9 | 20.1 | 11.920519 | 1.7658e-15 | 1.00000 | B | 0.860697 | 0.092045 |
| GNLA | CCCE | 10.0 | 0.3 | 11.0 | 18.159308 | 1.9656e-15 | 1.00000 | B | 0.909091 | 0.026686 |
| AAGK | CCCH | 13.3 | 0.6 | 36.1 | 16.855814 | 5.6027e-15 | 1.00000 | B | 0.368421 | 0.016035 |
| YSTM | CCCE | 19.6 | 2.1 | 42.7 | 12.437257 | 1.1609e-14 | 1.00000 | B | 0.459016 | 0.048830 |
| MNIF | CCHH | 20.6 | 2.5 | 41.1 | 11.694370 | 2.3532e-14 | 1.00000 | B | 0.501217 | 0.061842 |
| TGNT | CCHH | 13.5 | 0.9 | 18.9 | 14.035756 | 2.9887e-14 | 1.00000 | B | 0.714286 | 0.045000 |
| NICR | CCCH | 5.0 | 0.0 | 10.8 | 62.091204 | 3.1714e-14 | 1.00000 | B | 0.462963 | 0.000599 |
| QDKE | HHHH | 23.7 | 5.9 | 64.0 | 7.716774 | 3.1832e-14 | 1.00000 | N | 0.370312 | 0.091796 |
| FNTN | ECCC | 18.2 | 1.9 | 37.6 | 12.129079 | 3.7927e-14 | 1.00000 | B | 0.484043 | 0.050580 |
| SGRT | CCCC | 23.0 | 5.5 | 88.8 | 7.691022 | 3.9756e-14 | 1.00000 | N | 0.259009 | 0.062075 |
| YRDV | CCCC | 15.5 | 1.2 | 27.6 | 13.113855 | 5.0190e-14 | 1.00000 | B | 0.561594 | 0.044865 |
| VNHG | CCEE | 7.8 | 0.1 | 9.0 | 26.302593 | 5.5620e-14 | 1.00000 | B | 0.866667 | 0.009648 |
| VDKK | EEEE | 78.6 | 36.1 | 374.6 | 7.428060 | 1.0634e-13 | 1.00000 | N | 0.209824 | 0.096500 |
| GKSA | CHHH | 15.8 | 1.2 | 56.8 | 13.676079 | 1.1247e-13 | 1.00000 | B | 0.278169 | 0.020574 |
| GLTD | EECC | 10.6 | 0.5 | 11.4 | 14.766307 | 1.9385e-13 | 1.00000 | B | 0.929825 | 0.042968 |
| FTVA | CCHH | 13.1 | 0.9 | 19.6 | 12.935319 | 2.1141e-13 | 1.00000 | B | 0.668367 | 0.047415 |
| GGFM | CCCH | 10.0 | 0.5 | 10.7 | 13.957613 | 2.1432e-13 | 1.00000 | B | 0.934579 | 0.045486 |
| PPGP | CCCC | 25.6 | 4.3 | 82.9 | 10.497601 | 2.2505e-13 | 1.00000 | B | 0.308806 | 0.052246 |
| PTWN | CEEC | 13.5 | 0.5 | 10.5 | 13.872045 | 2.4774e-13 | 1.00000 | B | 1.285714 | 0.051741 |
| STMS | CCEE | 14.9 | 1.1 | 42.8 | 13.377328 | 2.6426e-13 | 1.00000 | B | 0.348131 | 0.025541 |
| GVCS | CHHH | 7.5 | 0.1 | 13.0 | 26.334228 | 2.7609e-13 | 1.00000 | B | 0.576923 | 0.006145 |
| YASG | HHCC | 17.3 | 1.9 | 36.0 | 11.586737 | 3.4799e-13 | 1.00000 | B | 0.480556 | 0.051958 |
| GGLM | CCCH | 12.2 | 0.7 | 19.9 | 13.592519 | 4.8030e-13 | 1.00000 | B | 0.613065 | 0.037107 |
| DACQ | ECCC | 7.1 | 0.1 | 26.6 | 26.117565 | 7.6453e-13 | 1.00000 | B | 0.266917 | 0.002729 |
| GLGR | CHHH | 11.0 | 0.6 | 16.8 | 13.543928 | 1.2177e-12 | 1.00000 | B | 0.654762 | 0.036346 |
| VSWG | EEEC | 13.9 | 0.9 | 142.4 | 13.792449 | 1.5390e-12 | 1.00000 | B | 0.097612 | 0.006283 |
| DSVT | EEEE | 20.6 | 3.2 | 45.4 | 10.115672 | 2.6490e-12 | 1.00000 | B | 0.453744 | 0.070196 |
| GIMS | CHHH | 5.0 | 0.0 | 5.0 | 31.463022 | 3.2056e-12 | 1.00000 | B | 1.000000 | 0.005026 |
| SGVG | CCCC | 20.6 | 5.0 | 135.3 | 7.083857 | 3.5288e-12 | 1.00000 | N | 0.152254 | 0.037119 |
| WNIG | ECCC | 12.3 | 0.5 | 9.3 | 12.738906 | 6.1148e-12 | 1.00000 | B | 1.322581 | 0.054202 |
| DSCQ | ECCC | 7.8 | 0.1 | 72.0 | 22.511242 | 8.3027e-12 | 1.00000 | B | 0.108333 | 0.001621 |
| QTPN | HCHH | 22.1 | 4.1 | 46.3 | 9.249495 | 8.5114e-12 | 1.00000 | B | 0.477322 | 0.089425 |
| KSRW | CCHH | 15.6 | 1.6 | 45.6 | 11.351320 | 8.7811e-12 | 1.00000 | B | 0.342105 | 0.034653 |
| STVE | EEEE | 17.0 | 2.4 | 30.0 | 9.755365 | 1.1687e-11 | 1.00000 | B | 0.566667 | 0.080927 |

TABLE 11-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ACNG | CCCC | 7.0 | 0.2 | 9.0 | 17.192673 | 2.0549e−11 | 1.00000 | B | 0.777778 | 0.017901 |
| GACW | ECHH | 5.7 | 0.0 | 4.0 | 40.933013 | 3.2174e−11 | 1.00000 | B | 1.425000 | 0.002382 |
| GVGR | CCHH | 7.3 | 0.1 | 23.6 | 19.823519 | 3.2681e−11 | 1.00000 | B | 0.309322 | 0.005572 |
| AGIG | CCCH | 5.9 | 0.0 | 26.5 | 30.927404 | 3.4380e−11 | 1.00000 | B | 0.222642 | 0.001358 |
| HGKT | CCHH | 8.0 | 0.2 | 36.2 | 16.510870 | 5.6930e−11 | 1.00000 | B | 0.220994 | 0.006166 |
| TLIS | EEEE | 13.7 | 1.3 | 44.6 | 11.229338 | 7.1321e−11 | 1.00000 | B | 0.307175 | 0.028307 |
| NTKV | CEEE | 38.0 | 14.4 | 156.3 | 6.545601 | 7.4133e−11 | 1.00000 | N | 0.243122 | 0.091884 |

TABLE 12

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ExxxR | HhhhH | 3545.7 | 1634.5 | 12751.1 | 50.628214 | 0.0000e+00 | 1.00000 | N | 0.278070 | 0.128187 |
| RxxxE | HhhhH | 2928.1 | 1427.8 | 11214.8 | 42.503045 | 0.0000e+00 | 1.00000 | N | 0.261092 | 0.127313 |
| QxxxD | HhhhH | 1521.3 | 666.8 | 5548.2 | 35.277704 | 1.3372e−272 | 1.00000 | N | 0.274197 | 0.120187 |
| RxxxR | HhhhH | 1627.7 | 735.0 | 5837.9 | 35.218117 | 1.0581e−271 | 1.00000 | N | 0.278816 | 0.125905 |
| ExxxE | HhhhH | 2968.6 | 1676.2 | 12774.8 | 33.866288 | 1.6289e−251 | 1.00000 | N | 0.232379 | 0.131213 |
| DxxxR | HhhhH | 1593.6 | 739.8 | 6057.4 | 33.503679 | 4.1121e−246 | 1.00000 | N | 0.263083 | 0.122130 |
| ExxxQ | HhhhH | 1903.9 | 965.9 | 7773.1 | 32.250622 | 3.0026e−228 | 1.00000 | N | 0.244934 | 0.124264 |
| AxxxR | HhhhH | 1716.6 | 888.8 | 9975.9 | 29.093571 | 3.6109e−186 | 1.00000 | N | 0.172075 | 0.089093 |
| QxxxR | HhhhH | 1090.8 | 488.7 | 4100.8 | 29.020942 | 3.6056e−185 | 1.00000 | N | 0.265997 | 0.119170 |
| AxxxA | HhhhH | 2239.1 | 1243.1 | 25522.9 | 28.964033 | 1.4239e−184 | 1.00000 | N | 0.087729 | 0.048705 |
| QxxxQ | HhhhH | 1076.2 | 488.7 | 4171.0 | 28.285687 | 5.1236e−176 | 1.00000 | N | 0.258020 | 0.117162 |
| QxxxE | HhhhH | 1661.6 | 884.6 | 7199.7 | 27.894386 | 2.5759e−171 | 1.00000 | N | 0.230787 | 0.122866 |
| ExxxA | HhhhH | 2448.2 | 1446.9 | 14973.0 | 27.696798 | 5.5984e−169 | 1.00000 | N | 0.163508 | 0.096632 |
| AxxxQ | HhhhH | 1200.9 | 575.4 | 6408.2 | 27.329373 | 1.7264e−164 | 1.00000 | N | 0.187401 | 0.089798 |
| RxxxQ | HhhhH | 1065.6 | 500.6 | 4150.3 | 26.972525 | 2.9554e−161 | 1.00000 | N | 0.256753 | 0.120469 |
| ExxxK | HhhhH | 3252.3 | 2124.9 | 15568.8 | 26.317913 | 8.1352e−153 | 1.00000 | N | 0.208899 | 0.136488 |
| ExxxL | HhhhH | 1724.7 | 952.4 | 13302.4 | 25.973127 | 7.7159e−149 | 1.00000 | N | 0.129653 | 0.071595 |
| QxxxN | HhhhH | 782.6 | 336.4 | 3046.6 | 25.795862 | 1.0406e−146 | 1.00000 | N | 0.256877 | 0.110409 |
| KxxxE | HhhhH | 2766.8 | 1765.1 | 13152.5 | 25.624911 | 5.5898e−145 | 1.00000 | N | 0.210363 | 0.134200 |
| RxxxL | HhhhH | 1346.1 | 698.5 | 9345.2 | 25.474971 | 3.0835e−143 | 1.00000 | N | 0.144042 | 0.074742 |
| LxxxR | HhhhH | 1256.2 | 640.3 | 9084.4 | 25.244635 | 1.0887e−140 | 1.00000 | N | 0.138281 | 0.070486 |
| LxxxE | HhhhH | 1373.3 | 739.2 | 9254.6 | 24.314227 | 1.1055e−130 | 1.00000 | N | 0.148391 | 0.079873 |
| NxxxR | HhhhH | 648.3 | 270.4 | 2518.1 | 24.322629 | 1.2367e−130 | 1.00000 | N | 0.257456 | 0.107389 |
| RxxxD | HhhhH | 1124.8 | 579.6 | 4662.5 | 24.197519 | 2.0224e−129 | 1.00000 | N | 0.241244 | 0.124320 |
| ExxxN | HhhhH | 1238.3 | 662.5 | 5424.4 | 23.874648 | 4.6110e−126 | 1.00000 | N | 0.228283 | 0.122138 |
| ExxxS | HhhhH | 1260.4 | 676.4 | 5947.2 | 23.853305 | 7.6202e−126 | 1.00000 | N | 0.211932 | 0.113731 |
| YxxxN | HhhhH | 359.7 | 114.6 | 1469.5 | 23.835304 | 2.2944e−125 | 1.00000 | N | 0.244777 | 0.078017 |
| AxxxE | HhhhH | 1813.4 | 1077.4 | 10751.7 | 23.638803 | 1.1253e−123 | 1.00000 | N | 0.168662 | 0.100207 |
| QxxxA | HhhhH | 1147.9 | 606.8 | 7180.5 | 22.960147 | 9.5018e−117 | 1.00000 | N | 0.159864 | 0.084501 |
| QxxxL | HhhhH | 851.0 | 410.1 | 7080.9 | 22.428266 | 1.8468e−111 | 1.00000 | N | 0.120182 | 0.057922 |
| NxxxQ | HhhhH | 622.6 | 276.1 | 2608.8 | 22.070213 | 6.1727e−108 | 1.00000 | N | 0.238730 | 0.105815 |
| KxxxD | HhhhH | 1559.9 | 937.5 | 7193.2 | 21.796348 | 1.8415e−105 | 1.00000 | N | 0.216858 | 0.130335 |
| LxxxQ | HhhhH | 838.5 | 412.3 | 6031.4 | 21.746653 | 6.4761e−105 | 1.00000 | N | 0.139022 | 0.068358 |
| YxxxR | HhhhH | 507.5 | 207.9 | 2808.6 | 21.590025 | 2.4287e−103 | 1.00000 | N | 0.180695 | 0.074032 |
| PxxxR | HhhhH | 719.8 | 345.7 | 3048.4 | 21.371192 | 2.2826e−101 | 1.00000 | N | 0.236124 | 0.113393 |
| RxxxA | HhhhH | 1371.7 | 800.6 | 8918.1 | 21.157309 | 1.7498e−99 | 1.00000 | N | 0.153811 | 0.089769 |
| YxxxK | HhhhH | 681.0 | 320.1 | 3778.3 | 21.088212 | 9.4565e−99 | 1.00000 | N | 0.180240 | 0.084710 |
| TxxxQ | HhhhH | 624.6 | 288.5 | 2880.6 | 20.861512 | 1.1458e−96 | 1.00000 | N | 0.216830 | 0.100147 |
| DxxxE | HhhhH | 1501.2 | 918.8 | 7072.8 | 20.599825 | 1.9838e−94 | 1.00000 | N | 0.212250 | 0.129901 |
| SxxxR | HhhhH | 800.7 | 407.6 | 4098.8 | 20.521420 | 1.1851e−93 | 1.00000 | N | 0.195350 | 0.099432 |
| YxxxL | HhhhH | 540.6 | 236.8 | 6880.9 | 20.088526 | 9.0430e−90 | 1.00000 | N | 0.078565 | 0.034417 |
| RxxxN | HhhhH | 653.6 | 316.9 | 2892.5 | 20.040727 | 2.2101e−89 | 1.00000 | N | 0.225964 | 0.109571 |
| KxxxR | HhhhH | 1011.6 | 569.9 | 4523.9 | 19.791965 | 2.7224e−87 | 1.00000 | N | 0.223612 | 0.125972 |
| DxxxQ | HhhhH | 930.8 | 512.8 | 4144.6 | 19.719888 | 1.1598e−86 | 1.00000 | N | 0.224581 | 0.123724 |
| SxxxQ | HhhhH | 680.2 | 338.0 | 3360.0 | 19.626339 | 8.0947e−86 | 1.00000 | N | 0.202440 | 0.100596 |
| VxxxE | HhhhH | 776.9 | 402.6 | 5432.9 | 19.383764 | 8.7489e−84 | 1.00000 | N | 0.142999 | 0.074111 |
| SxxxE | HhhhH | 986.8 | 556.7 | 5025.9 | 19.331093 | 2.2728e−83 | 1.00000 | N | 0.196343 | 0.110765 |
| HxxxE | HhhhH | 519.1 | 238.2 | 2247.4 | 19.253484 | 1.2780e−82 | 1.00000 | N | 0.230978 | 0.105970 |
| AxxxD | HhhhH | 831.5 | 447.2 | 4633.8 | 19.121192 | 1.3547e−81 | 1.00000 | N | 0.179442 | 0.096500 |
| AxxxS | HhhhH | 815.9 | 432.0 | 6889.2 | 19.076253 | 3.1981e−81 | 1.00000 | N | 0.118432 | 0.062711 |
| DxxxA | HhhhH | 1305.7 | 800.2 | 8841.7 | 18.737176 | 1.7447e−78 | 1.00000 | N | 0.147675 | 0.090505 |
| LxxxE | CchhH | 488.7 | 220.5 | 3253.3 | 18.701598 | 4.6170e−78 | 1.00000 | N | 0.150217 | 0.067791 |
| ExxxD | HhhhH | 1027.9 | 600.3 | 4905.2 | 18.630742 | 1.3593e−77 | 1.00000 | N | 0.209553 | 0.122376 |
| SxxxA | HhhhH | 836.8 | 452.6 | 7696.8 | 18.615784 | 1.8805e−77 | 1.00000 | N | 0.108721 | 0.058802 |
| TxxxR | HhhhH | 665.8 | 341.1 | 3439.7 | 18.522474 | 1.1550e−76 | 1.00000 | N | 0.193563 | 0.099169 |
| IxxxE | HhhhH | 652.0 | 328.6 | 4866.2 | 18.486861 | 2.2361e−76 | 1.00000 | N | 0.134017 | 0.067526 |
| SxxxH | HhhhH | 315.2 | 120.9 | 1433.7 | 18.466932 | 4.5899e−76 | 1.00000 | N | 0.219851 | 0.084326 |
| QxxxS | HhhhH | 623.3 | 314.0 | 3007.9 | 18.442239 | 5.2220e−76 | 1.00000 | N | 0.207221 | 0.104399 |
| LxxxQ | CchhH | 328.0 | 127.5 | 1903.8 | 18.382341 | 2.1159e−75 | 1.00000 | N | 0.172287 | 0.066973 |
| PxxxA | HhhhH | 816.8 | 444.6 | 6116.7 | 18.331464 | 3.6493e−75 | 1.00000 | N | 0.133536 | 0.072684 |
| FxxxQ | HhhhH | 322.3 | 125.4 | 2057.5 | 18.151574 | 1.4421e−73 | 1.00000 | N | 0.156646 | 0.060927 |

TABLE 12-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ExxxY | HhhhH | 629.3 | 321.2 | 3734.6 | 17.978943 | 2.4098e−72 | 1.00000 | N | 0.168505 | 0.086016 |
| YxxxQ | HhhhH | 376.9 | 159.4 | 2150.4 | 17.908928 | 1.0512e−71 | 1.00000 | N | 0.175270 | 0.074107 |
| KxxxQ | HhhhH | 1012.7 | 602.6 | 4794.5 | 17.866819 | 1.5795e−71 | 1.00000 | N | 0.211221 | 0.125685 |
| VxxxR | HhhhH | 729.3 | 391.2 | 5584.0 | 17.726047 | 2.1028e−70 | 1.00000 | N | 0.130605 | 0.070058 |
| IxxxN | HhhhH | 403.8 | 176.6 | 2697.7 | 17.686932 | 5.2702e−70 | 1.00000 | N | 0.149683 | 0.065459 |
| NxxxE | HhhhH | 854.2 | 488.3 | 4085.1 | 17.649644 | 7.8447e−70 | 1.00000 | N | 0.209101 | 0.119520 |
| ExxxI | HhhhH | 758.2 | 412.4 | 6102.5 | 17.633481 | 1.0697e−69 | 1.00000 | N | 0.124244 | 0.067581 |
| IxxxR | HhhhH | 603.5 | 306.0 | 4707.3 | 17.585071 | 2.6989e−69 | 1.00000 | N | 0.128205 | 0.065013 |
| CxxxH | HhhhH | 107.1 | 23.6 | 476.2 | 17.656516 | 2.9300e−69 | 1.00000 | N | 0.224906 | 0.049463 |
| MxxxE | CchhH | 292.0 | 113.4 | 1275.4 | 17.563916 | 5.5301e−69 | 1.00000 | N | 0.228948 | 0.088946 |
| NxxxS | HhhhH | 514.3 | 251.1 | 2512.2 | 17.506813 | 1.1392e−68 | 1.00000 | N | 0.204721 | 0.099956 |
| QxxxT | HhhhH | 555.2 | 279.9 | 2775.6 | 17.354733 | 1.5715e−67 | 1.00000 | N | 0.200029 | 0.100838 |
| HxxxQ | HhhhH | 327.4 | 136.5 | 1404.3 | 17.198608 | 2.9556e−66 | 1.00000 | N | 0.233141 | 0.097192 |
| VxxxN | HhhhH | 437.6 | 204.7 | 2937.8 | 16.882201 | 5.6161e−64 | 1.00000 | N | 0.148955 | 0.069662 |
| DxxxS | HhhhH | 723.1 | 404.9 | 3662.5 | 16.770933 | 3.1011e−63 | 1.00000 | N | 0.197433 | 0.110539 |
| DxxxD | HhhhH | 761.9 | 435.3 | 3587.0 | 16.698203 | 1.0362e−62 | 1.00000 | N | 0.212406 | 0.121362 |
| SxxxS | HhhhH | 612.2 | 324.9 | 3868.8 | 16.653077 | 2.3318e−62 | 1.00000 | N | 0.158240 | 0.083981 |
| PxxxE | HhhhH | 874.8 | 522.0 | 4147.7 | 16.516679 | 2.0506e−61 | 1.00000 | N | 0.210912 | 0.125850 |
| FxxxR | HhhhH | 380.5 | 171.4 | 2686.2 | 16.507278 | 3.1248e−61 | 1.00000 | N | 0.141650 | 0.063807 |
| TxxxE | HhhhH | 774.7 | 446.4 | 4237.2 | 16.426992 | 9.2564e−61 | 1.00000 | N | 0.182833 | 0.105356 |
| WxxxQ | HhhhH | 201.9 | 69.9 | 1001.1 | 16.362918 | 4.8607e−60 | 1.00000 | N | 0.201678 | 0.069854 |
| LxxxH | HhhhH | 363.9 | 162.7 | 3238.0 | 16.184271 | 6.2530e−59 | 1.00000 | N | 0.112384 | 0.050250 |
| IxxxQ | HhhhH | 400.2 | 186.3 | 3042.8 | 16.174438 | 7.0518e−59 | 1.00000 | N | 0.131524 | 0.061226 |
| DxxxK | HhhhH | 1418.7 | 960.1 | 7235.1 | 15.890960 | 4.8245e−57 | 1.00000 | N | 0.196086 | 0.132705 |
| ExxxT | HhhhH | 863.4 | 520.4 | 5003.9 | 15.884514 | 5.8664e−57 | 1.00000 | N | 0.172545 | 0.103999 |
| RxxxK | HhhhH | 1047.0 | 667.3 | 5094.2 | 15.769294 | 3.5148e−56 | 1.00000 | N | 0.205528 | 0.130986 |
| NxxxN | HhhhH | 411.8 | 201.8 | 1933.5 | 15.625829 | 4.3487e−55 | 1.00000 | N | 0.212982 | 0.104345 |
| HxxxR | HhhhH | 321.8 | 143.5 | 1583.7 | 15.607413 | 6.4283e−55 | 1.00000 | N | 0.203195 | 0.090614 |
| NxxxL | HhhhH | 450.7 | 223.9 | 4154.2 | 15.578085 | 8.7727e−55 | 1.00000 | N | 0.108493 | 0.053909 |
| SxxxN | HhhhH | 487.3 | 253.1 | 2480.3 | 15.534756 | 1.6921e−54 | 1.00000 | N | 0.196468 | 0.102045 |
| DxxxN | HhhhH | 594.3 | 330.2 | 2767.7 | 15.489774 | 3.2073e−54 | 1.00000 | N | 0.214727 | 0.119292 |
| ExxxH | HhhhH | 551.1 | 300.0 | 2737.5 | 15.360468 | 2.4145e−53 | 1.00000 | N | 0.201315 | 0.109602 |
| YxxxE | HhhhH | 396.8 | 192.7 | 2422.9 | 15.323125 | 4.7702e−53 | 1.00000 | N | 0.163771 | 0.079539 |
| LxxxN | HhhhH | 499.1 | 260.5 | 3907.2 | 15.305012 | 5.7912e−53 | 1.00000 | N | 0.127739 | 0.066663 |
| PxxxQ | HhhhH | 489.4 | 259.6 | 2215.5 | 15.182747 | 3.8046e−52 | 1.00000 | N | 0.220898 | 0.117159 |
| QxxxW | HhhhH | 165.8 | 55.6 | 973.5 | 15.206793 | 4.5631e−52 | 1.00000 | N | 0.170313 | 0.057164 |
| ExxxR | HhhhC | 358.1 | 171.9 | 1395.4 | 15.161362 | 5.9193e−52 | 1.00000 | N | 0.256629 | 0.123222 |
| LxxxL | HhhhH | 997.1 | 625.8 | 27017.2 | 15.017249 | 3.8391e−51 | 1.00000 | N | 0.036906 | 0.023163 |

TABLE 13

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| NxxDL | EccCC | 52.0 | 5.7 | 142.7 | 19.794530 | 1.1279e−85 | 1.00000 | N | 0.364401 | 0.039936 |
| TxxGK | CccCH | 57.5 | 7.2 | 179.0 | 19.161164 | 1.4880e−80 | 1.00000 | N | 0.321229 | 0.040133 |
| SxxYH | HhhHH | 55.1 | 7.3 | 104.0 | 18.276180 | 2.0986e−73 | 1.00000 | N | 0.529808 | 0.070636 |
| GxxKS | CccHH | 81.1 | 15.9 | 322.6 | 16.741561 | 2.8010e−62 | 1.00000 | N | 0.251395 | 0.049402 |
| CxxCH | HhhCC | 51.8 | 7.9 | 109.2 | 16.170548 | 7.9700e−58 | 1.00000 | N | 0.474359 | 0.072665 |
| ExxRR | HhhHH | 299.8 | 133.8 | 1539.6 | 15.024308 | 5.0311e−51 | 1.00000 | N | 0.194726 | 0.086878 |
| CxxCH | HhhHH | 52.6 | 9.3 | 112.0 | 14.780082 | 1.2263e−48 | 1.00000 | N | 0.469643 | 0.083434 |
| SxxGK | CccCH | 44.6 | 6.8 | 222.2 | 14.731787 | 3.5333e−48 | 1.00000 | N | 0.200720 | 0.030575 |
| GxxKT | CccCH | 72.0 | 15.7 | 369.5 | 14.495654 | 4.1781e−47 | 1.00000 | N | 0.194858 | 0.042587 |
| AxxAA | HhhHH | 232.6 | 96.4 | 3380.2 | 14.070952 | 5.9399e−45 | 1.00000 | N | 0.068812 | 0.028524 |
| CxxCH | ChhHH | 41.5 | 2.9 | 62.5 | 23.302795 | 9.4544e−40 | 1.00000 | B | 0.664000 | 0.046071 |
| ExxRL | HhhHH | 194.4 | 85.3 | 1592.4 | 12.143932 | 6.0904e−34 | 1.00000 | N | 0.122080 | 0.053562 |
| YxxEN | HhhHH | 47.1 | 12.1 | 158.4 | 10.435507 | 4.0653e−25 | 1.00000 | N | 0.297348 | 0.076699 |
| ExxRE | HhhHH | 240.2 | 130.3 | 1378.1 | 10.115517 | 3.7685e−24 | 1.00000 | N | 0.174298 | 0.094564 |
| AxxTT | CchHH | 31.4 | 3.0 | 95.3 | 16.791123 | 1.7851e−23 | 1.00000 | B | 0.329486 | 0.031067 |
| DxxRR | HhhHH | 121.9 | 52.8 | 600.5 | 9.963409 | 2.2695e−23 | 1.00000 | N | 0.202998 | 0.087883 |
| AxxRR | HhhHH | 119.0 | 51.0 | 722.4 | 9.873794 | 5.5640e−23 | 1.00000 | N | 0.164729 | 0.070617 |
| DxxGK | CccCH | 31.4 | 3.2 | 84.3 | 16.156690 | 6.4849e−23 | 1.00000 | B | 0.372479 | 0.037626 |
| ExxRA | HhhHH | 216.7 | 115.4 | 1491.6 | 9.812480 | 8.0321e−23 | 1.00000 | N | 0.145280 | 0.077390 |
| PxxGK | CccCH | 37.1 | 8.6 | 207.4 | 9.893210 | 1.2460e−22 | 1.00000 | N | 0.178881 | 0.041644 |
| YxxGR | HhcCC | 27.9 | 5.6 | 83.6 | 9.814050 | 4.2178e−22 | 1.00000 | N | 0.333732 | 0.066430 |
| AxxER | HhhHH | 160.2 | 78.8 | 960.0 | 9.579453 | 8.6052e−22 | 1.00000 | N | 0.166875 | 0.082033 |
| CxxCW | CecHH | 10.1 | 0.0 | 32.8 | 49.128009 | 8.8894e−22 | 1.00000 | B | 0.307927 | 0.001280 |
| QxxAA | HhhHH | 119.9 | 52.6 | 1024.0 | 9.528485 | 1.5740e−21 | 1.00000 | N | 0.117090 | 0.051362 |
| HxxNE | HhhHH | 36.8 | 9.1 | 122.0 | 9.582928 | 2.4752e−21 | 1.00000 | N | 0.301639 | 0.074219 |
| RxxMD | HhhEC | 17.1 | 0.6 | 44.2 | 22.238496 | 2.7644e−21 | 1.00000 | B | 0.386878 | 0.012675 |
| NxxCK | EecCC | 24.2 | 2.0 | 45.0 | 15.927613 | 6.0120e−21 | 1.00000 | B | 0.537778 | 0.045091 |
| AxxRA | HhhHH | 165.8 | 82.7 | 1804.6 | 9.359131 | 6.8374e−21 | 1.00000 | N | 0.091876 | 0.045813 |
| ExxRQ | HhhHH | 149.6 | 73.1 | 886.5 | 9.344841 | 8.1784e−21 | 1.00000 | N | 0.168754 | 0.082435 |
| ExxAA | HhhHC | 52.1 | 16.1 | 214.0 | 9.306055 | 2.2237e−20 | 1.00000 | N | 0.243458 | 0.075445 |

TABLE 13-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| PxxNI | CeeCC | 14.4 | 0.5 | 13.3 | 19.167577 | 1.9524e−19 | 1.00000 | B | 1.082707 | 0.034936 |
| QxxEG | HhhHC | 34.9 | 8.9 | 104.9 | 9.070130 | 2.9112e−19 | 1.00000 | N | 0.332698 | 0.085314 |
| SxxAA | HhhHH | 78.9 | 30.6 | 960.7 | 8.862496 | 8.8792e−19 | 1.00000 | N | 0.082128 | 0.031889 |
| AxxAR | HhhHH | 118.4 | 54.8 | 1244.1 | 8.783439 | 1.4619e−18 | 1.00000 | N | 0.095169 | 0.044062 |
| AxxSQ | HhhHC | 32.8 | 8.4 | 98.7 | 8.827817 | 2.6401e−18 | 1.00000 | N | 0.332320 | 0.084790 |
| AxxEA | HhhHH | 188.2 | 103.4 | 2180.2 | 8.538938 | 1.0460e−17 | 1.00000 | N | 0.086322 | 0.047445 |
| GxxNS | CchHH | 25.9 | 3.1 | 66.8 | 13.347601 | 1.3878e−17 | 1.00000 | B | 0.387725 | 0.045915 |
| NxxPN | HhcHH | 25.0 | 5.6 | 53.4 | 8.621938 | 2.2460e−17 | 1.00000 | N | 0.468165 | 0.105585 |
| SxxGN | CccCH | 16.7 | 1.1 | 22.8 | 15.333850 | 3.2588e−17 | 1.00000 | B | 0.732456 | 0.047742 |
| YxxNF | CccCC | 23.9 | 5.1 | 96.2 | 8.563062 | 3.8617e−17 | 1.00000 | N | 0.248441 | 0.052944 |
| SxxVD | CeeEE | 71.1 | 28.4 | 311.2 | 8.413504 | 4.5859e−17 | 1.00000 | N | 0.228470 | 0.091179 |
| ExxLA | HhhHH | 172.9 | 94.5 | 1763.6 | 8.285516 | 9.1556e−17 | 1.00000 | N | 0.098038 | 0.053601 |
| HxxQA | HhhCH | 1.0 | 0.1 | 1.0 | 3.306715 | 1.0172e−16 | 1.00000 | B | 1.000000 | 0.083792 |
| ExxAA | HhhHH | 179.9 | 99.7 | 1794.4 | 8.266710 | 1.0592e−16 | 1.00000 | N | 0.100256 | 0.055555 |
| TxxDK | EeeEE | 91.2 | 40.9 | 412.9 | 8.290419 | 1.1242e−16 | 1.00000 | N | 0.220877 | 0.099016 |
| RxxRE | HhhHH | 141.4 | 74.0 | 828.4 | 8.217981 | 1.7164e−16 | 1.00000 | N | 0.170690 | 0.089275 |
| VxxHE | HhhHH | 28.9 | 4.0 | 173.8 | 12.540326 | 2.2042e−16 | 1.00000 | B | 0.166283 | 0.023172 |
| KxxGA | HhcCC | 44.0 | 13.9 | 283.3 | 8.262977 | 2.2260e−16 | 1.00000 | N | 0.155312 | 0.049167 |
| RxxGI | HhcCC | 41.0 | 12.7 | 265.2 | 8.142027 | 6.3123e−16 | 1.00000 | N | 0.154600 | 0.047865 |
| AxxRT | HccCC | 23.5 | 5.3 | 79.3 | 8.142951 | 1.1990e−15 | 1.00000 | N | 0.296343 | 0.067278 |
| VxxGA | HhcCC | 33.4 | 9.3 | 235.9 | 8.076537 | 1.2963e−15 | 1.00000 | N | 0.141585 | 0.039348 |
| KxxGF | HhcCC | 37.3 | 11.3 | 204.8 | 7.969461 | 2.7196e−15 | 1.00000 | N | 0.182129 | 0.055082 |
| AxxRD | HhhHH | 77.3 | 33.4 | 420.4 | 7.903500 | 2.7836e−15 | 1.00000 | N | 0.183873 | 0.079560 |
| CxxCH | CccCC | 24.7 | 5.9 | 98.0 | 8.021387 | 2.8947e−15 | 1.00000 | N | 0.252041 | 0.059844 |
| AxxAS | HhhHH | 77.3 | 33.1 | 862.3 | 7.834917 | 4.7308e−15 | 1.00000 | N | 0.089644 | 0.038384 |
| AxxAE | HhhHH | 133.4 | 70.4 | 1311.8 | 7.716222 | 9.6679e−15 | 1.00000 | N | 0.101692 | 0.053677 |
| SxxGL | HhhCC | 27.2 | 7.0 | 120.2 | 7.839361 | 1.0445e−14 | 1.00000 | N | 0.226290 | 0.058491 |
| ExxGL | HhcCC | 64.7 | 26.4 | 437.9 | 7.674219 | 1.8107e−14 | 1.00000 | N | 0.147751 | 0.060392 |
| VxxKN | EccCC | 29.4 | 8.2 | 105.5 | 7.747512 | 1.9363e−14 | 1.00000 | N | 0.278673 | 0.077267 |
| LxxLH | HhhHH | 39.2 | 12.4 | 609.3 | 7.696374 | 2.1292e−14 | 1.00000 | N | 0.064336 | 0.020332 |
| AxxRE | HhhHH | 138.9 | 75.7 | 940.9 | 7.575524 | 2.8327e−14 | 1.00000 | N | 0.147625 | 0.080452 |
| ExxLS | HhhHH | 102.2 | 50.1 | 839.3 | 7.584261 | 2.9242e−14 | 1.00000 | N | 0.121768 | 0.059728 |
| ExxGA | HhhCC | 41.1 | 13.7 | 243.7 | 7.613209 | 3.8832e−14 | 1.00000 | N | 0.168650 | 0.056268 |
| KxxAC | EeeCC | 18.1 | 1.8 | 44.0 | 12.344442 | 3.9683e−14 | 1.00000 | B | 0.411364 | 0.041254 |
| HxxKV | HhhHH | 33.0 | 9.8 | 164.9 | 7.631524 | 4.1038e−14 | 1.00000 | N | 0.200121 | 0.059517 |
| AxxAA | HhhHC | 61.6 | 25.0 | 435.1 | 7.547460 | 4.8688e−14 | 1.00000 | N | 0.141577 | 0.057408 |
| AxxGL | HhhCC | 41.1 | 13.8 | 280.1 | 7.540236 | 6.6990e−14 | 1.00000 | N | 0.146733 | 0.049246 |
| SxxTT | CchHH | 22.4 | 3.0 | 85.8 | 11.509229 | 7.9920e−14 | 1.00000 | B | 0.261072 | 0.034452 |
| AxxRH | HhhHH | 52.1 | 19.9 | 294.8 | 7.480402 | 8.9042e−14 | 1.00000 | N | 0.176730 | 0.067458 |
| RxxGL | HhcCC | 53.5 | 20.6 | 336.0 | 7.465023 | 9.8050e−14 | 1.00000 | N | 0.159226 | 0.061435 |
| CxxCH | HhhHE | 13.2 | 1.3 | 13.5 | 11.110583 | 1.4758e−13 | 1.00000 | B | 0.977778 | 0.094252 |
| AxxAQ | HhhHH | 79.5 | 36.2 | 761.4 | 7.381135 | 1.4828e−13 | 1.00000 | N | 0.104413 | 0.047510 |
| LxxNV | CchHH | 25.9 | 4.5 | 77.5 | 10.453245 | 1.5252e−13 | 1.00000 | B | 0.334194 | 0.057583 |
| AxxQD | HhhHH | 65.9 | 28.4 | 324.1 | 7.377042 | 1.6844e−13 | 1.00000 | N | 0.203332 | 0.087528 |
| GxxGK | CccCH | 26.0 | 6.8 | 249.5 | 7.472893 | 1.6894e−13 | 1.00000 | N | 0.104208 | 0.027222 |
| MxxCT | EecCC | 8.0 | 0.1 | 11.6 | 20.815710 | 1.7845e−13 | 1.00000 | B | 0.689655 | 0.012433 |
| PxxAA | HhhHH | 66.0 | 27.9 | 816.2 | 7.342254 | 2.1476e−13 | 1.00000 | N | 0.080863 | 0.034173 |
| NxxHQ | HhhHH | 21.3 | 5.1 | 62.2 | 7.471413 | 2.2332e−13 | 1.00000 | N | 0.342444 | 0.082215 |
| MxxSR | HhhHC | 19.9 | 2.5 | 52.1 | 11.260987 | 2.7264e−13 | 1.00000 | B | 0.381958 | 0.048106 |
| KxxDG | EccCC | 71.2 | 31.9 | 339.7 | 7.297480 | 2.9121e−13 | 1.00000 | N | 0.209597 | 0.094033 |
| DxxRA | HhhHH | 112.5 | 58.9 | 823.5 | 7.256832 | 3.2587e−13 | 1.00000 | N | 0.136612 | 0.071469 |
| DxxRN | HhhHC | 24.5 | 6.5 | 74.9 | 7.380530 | 3.6042e−13 | 1.00000 | N | 0.327103 | 0.086891 |
| AxxQA | HhhHH | 113.8 | 59.5 | 1177.6 | 7.223678 | 4.1184e−13 | 1.00000 | N | 0.096637 | 0.050530 |
| DxxSN | HhhHH | 31.0 | 9.4 | 133.5 | 7.288476 | 5.4139e−13 | 1.00000 | N | 0.232210 | 0.070612 |
| NxxRN | HhhHH | 33.2 | 10.6 | 140.1 | 7.236560 | 7.3844e−13 | 1.00000 | N | 0.236974 | 0.075474 |
| ExxLP | HhhCC | 31.6 | 9.7 | 176.5 | 7.229156 | 8.0852e−13 | 1.00000 | N | 0.179037 | 0.054991 |
| CxxNI | EccCC | 8.0 | 0.2 | 15.3 | 20.051595 | 8.1343e−13 | 1.00000 | B | 0.522876 | 0.010108 |
| VxxTS | CchHH | 18.0 | 2.1 | 58.7 | 11.324529 | 9.1748e−13 | 1.00000 | B | 0.306644 | 0.035000 |
| CxxCH | HhhHC | 21.4 | 3.5 | 40.7 | 10.054804 | 9.3614e−13 | 1.00000 | B | 0.525799 | 0.085377 |
| CxxCW | CccHH | 6.6 | 0.0 | 35.7 | 33.489514 | 1.1250e−12 | 1.00000 | B | 0.184874 | 0.001076 |
| QxxMS | CchHH | 7.0 | 0.1 | 8.0 | 20.029061 | 1.3328e−12 | 1.00000 | B | 0.875000 | 0.014974 |
| PxxLT | HhhHH | 34.7 | 11.3 | 229.3 | 7.111345 | 1.7124e−12 | 1.00000 | N | 0.151330 | 0.049482 |
| AxxQQ | HhhHH | 73.7 | 34.2 | 442.5 | 7.033591 | 1.8980e−12 | 1.00000 | N | 0.166554 | 0.077271 |
| GxxAA | HhhHH | 53.5 | 21.4 | 1130.0 | 7.016140 | 2.4760e−12 | 1.00000 | N | 0.047345 | 0.018914 |
| AxxGR | CccHH | 15.6 | 1.4 | 64.8 | 12.259572 | 2.5530e−12 | 1.00000 | B | 0.240741 | 0.021226 |
| AxxDA | HhhHH | 99.9 | 51.3 | 1121.1 | 6.945769 | 3.1146e−12 | 1.00000 | N | 0.089109 | 0.045761 |
| QxxGL | CccCH | 17.9 | 2.2 | 47.3 | 10.729026 | 4.0680e−12 | 1.00000 | B | 0.378436 | 0.047294 |
| SxxDS | HhhHH | 28.9 | 8.9 | 121.4 | 6.997453 | 4.4603e−12 | 1.00000 | N | 0.238056 | 0.072925 |
| QxxND | HhhHH | 36.3 | 12.7 | 151.8 | 6.922566 | 6.1794e−12 | 1.00000 | N | 0.239130 | 0.083607 |

TABLE 14

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxGxS | CcChH | 90.7 | 18.3 | 441.1 | 17.277824 | 2.7158e−66 | 1.00000 | N | 0.205622 | 0.041517 |
| GxGxT | CcChH | 82.9 | 19.3 | 472.3 | 14.775292 | 5.8901e−49 | 1.00000 | N | 0.175524 | 0.040888 |
| AxKxT | CcHhH | 46.2 | 2.3 | 132.8 | 28.973360 | 3.8354e−46 | 1.00000 | B | 0.347892 | 0.017570 |
| SxKxT | CcHhH | 45.9 | 2.3 | 169.0 | 28.763578 | 1.0498e−44 | 1.00000 | B | 0.271598 | 0.013768 |
| VxKxS | CcHhH | 34.5 | 1.5 | 112.2 | 27.236570 | 1.7784e−36 | 1.00000 | B | 0.307487 | 0.013269 |
| GxGxG | CcChH | 43.7 | 8.6 | 269.1 | 12.148832 | 2.3822e−33 | 1.00000 | N | 0.162393 | 0.032017 |
| TxVxK | EeEeE | 106.2 | 37.4 | 568.5 | 11.640466 | 3.4471e−31 | 1.00000 | N | 0.186807 | 0.065781 |
| SxKxD | CeEeE | 66.9 | 19.0 | 237.4 | 11.470166 | 3.6870e−30 | 1.00000 | N | 0.281803 | 0.079926 |
| TxTxK | CcCcH | 29.5 | 1.8 | 56.2 | 20.951875 | 9.2706e−29 | 1.00000 | B | 0.524911 | 0.032121 |
| VxCxN | EcCcC | 28.9 | 2.1 | 67.3 | 19.011379 | 1.1251e−25 | 1.00000 | B | 0.429421 | 0.030557 |
| SxVxK | CcCcH | 25.8 | 1.9 | 101.1 | 17.528911 | 1.3538e−21 | 1.00000 | B | 0.255193 | 0.018747 |
| GxTxS | CcHhH | 25.7 | 2.3 | 77.1 | 15.700551 | 6.1084e−20 | 1.00000 | B | 0.333333 | 0.029715 |
| QxGxT | CcChH | 22.7 | 1.9 | 40.4 | 15.608649 | 9.3613e−20 | 1.00000 | B | 0.561881 | 0.046230 |
| DxAxK | CcCcH | 22.0 | 1.7 | 62.2 | 15.851300 | 4.4906e−19 | 1.00000 | B | 0.353698 | 0.027136 |
| KxDxK | EeEeE | 78.2 | 31.5 | 395.3 | 8.663783 | 5.1313e−18 | 1.00000 | N | 0.197824 | 0.079765 |
| SxTxV | HcEeE | 67.5 | 26.5 | 339.7 | 8.277657 | 1.4600e−16 | 1.00000 | N | 0.198705 | 0.078155 |
| SxTxN | CcCcH | 15.3 | 1.0 | 22.5 | 15.029372 | 3.7791e−16 | 1.00000 | B | 0.680000 | 0.042297 |
| QxPxS | EeCcE | 34.5 | 9.6 | 273.2 | 8.163922 | 6.2295e−16 | 1.00000 | N | 0.126293 | 0.035226 |
| QxKxG | HhHhC | 36.0 | 10.4 | 188.4 | 8.142734 | 7.1133e−16 | 1.00000 | N | 0.191083 | 0.055388 |
| KxVxC | EeEcC | 19.9 | 1.9 | 57.7 | 13.267711 | 2.7457e−15 | 1.00000 | B | 0.344887 | 0.032977 |
| NxAxK | EeCcC | 24.7 | 3.6 | 55.5 | 11.503434 | 4.7976e−15 | 1.00000 | B | 0.445045 | 0.064834 |
| GxTxY | CcEeE | 52.6 | 19.4 | 391.0 | 7.732901 | 1.3037e−14 | 1.00000 | N | 0.134527 | 0.049610 |
| RxKxG | EcCcC | 27.1 | 7.1 | 109.2 | 7.781732 | 1.6320e−14 | 1.00000 | N | 0.248168 | 0.064822 |
| AxGxR | HcCcC | 36.6 | 11.5 | 170.4 | 7.680274 | 2.5874e−14 | 1.00000 | N | 0.214789 | 0.067340 |
| SxGxG | EeCcC | 26.3 | 6.7 | 281.3 | 7.709803 | 2.8760e−14 | 1.00000 | N | 0.093494 | 0.023647 |
| NxGxT | CcChH | 20.3 | 2.4 | 51.0 | 11.698574 | 5.4820e−14 | 1.00000 | B | 0.398039 | 0.047969 |
| PxWxI | CeEcC | 12.3 | 0.3 | 9.3 | 15.817318 | 1.4860e−13 | 1.00000 | B | 1.322581 | 0.035840 |
| SxGxG | CcCcH | 25.0 | 3.9 | 151.4 | 10.870832 | 1.7440e−13 | 1.00000 | B | 0.165125 | 0.025597 |
| TxMxF | CcCcC | 18.4 | 2.0 | 52.3 | 11.772241 | 2.9763e−13 | 1.00000 | B | 0.351816 | 0.038525 |
| GxSxE | CcChH | 87.9 | 42.3 | 619.0 | 7.264315 | 3.3686e−13 | 1.00000 | N | 0.142003 | 0.068333 |
| RxRxG | EcCcC | 21.8 | 5.3 | 79.6 | 7.390263 | 3.8620e−13 | 1.00000 | N | 0.273869 | 0.066905 |
| CxAxI | CcCcC | 15.6 | 1.3 | 50.1 | 12.992225 | 4.0316e−13 | 1.00000 | B | 0.311377 | 0.024970 |
| RxSxT | EeCcC | 21.8 | 3.0 | 83.5 | 10.987197 | 5.0613e−13 | 1.00000 | B | 0.261078 | 0.036272 |
| QxNxQ | EeCcC | 19.3 | 2.7 | 36.1 | 10.437162 | 9.0830e−13 | 1.00000 | B | 0.534626 | 0.075549 |
| AxGxT | HcCcC | 38.3 | 13.1 | 237.7 | 7.177890 | 9.9181e−13 | 1.00000 | N | 0.161127 | 0.054993 |
| CxGxH | ChHhH | 9.4 | 0.3 | 13.6 | 16.130102 | 1.8371e−12 | 1.00000 | B | 0.691176 | 0.023847 |
| QxGxC | CcCcH | 12.3 | 0.8 | 22.2 | 12.974678 | 2.2038e−12 | 1.00000 | B | 0.554054 | 0.036647 |
| QxNxN | CeCcC | 17.6 | 2.4 | 31.2 | 10.223071 | 5.2458e−12 | 1.00000 | B | 0.564103 | 0.076790 |
| NxKxD | CeEeE | 36.1 | 12.5 | 155.1 | 6.939188 | 5.5327e−12 | 1.00000 | N | 0.232753 | 0.080856 |
| QxPxR | HcHhH | 18.2 | 2.4 | 55.2 | 10.489330 | 7.0720e−12 | 1.00000 | B | 0.329710 | 0.043075 |
| YxSxR | HhCcC | 18.3 | 2.5 | 49.8 | 10.332758 | 8.5782e−12 | 1.00000 | B | 0.367470 | 0.049592 |
| MxIxE | CcHhH | 20.5 | 5.1 | 117.7 | 6.943104 | 9.2565e−12 | 1.00000 | N | 0.174172 | 0.043553 |
| GxTxW | EeCcC | 9.1 | 0.4 | 14.3 | 14.427172 | 1.2572e−11 | 1.00000 | B | 0.636364 | 0.026262 |
| GxExF | CcCeE | 20.1 | 5.0 | 116.8 | 6.848623 | 1.7824e−11 | 1.00000 | N | 0.172089 | 0.043222 |
| DxNxE | CcChH | 25.1 | 7.3 | 128.5 | 6.781685 | 2.1820e−11 | 1.00000 | N | 0.195331 | 0.056827 |
| VxKxC | CcHhH | 10.0 | 0.4 | 62.5 | 14.474398 | 2.4703e−11 | 1.00000 | B | 0.160000 | 0.007030 |
| HxNxR | EeEeE | 10.4 | 0.5 | 41.7 | 14.375158 | 2.5174e−11 | 1.00000 | B | 0.249400 | 0.011550 |
| CxNxQ | CcCcC | 20.1 | 3.1 | 82.3 | 9.762451 | 2.6118e−11 | 1.00000 | B | 0.244228 | 0.038133 |
| AxVxR | CcChH | 10.8 | 0.6 | 30.0 | 13.215029 | 5.4998e−11 | 1.00000 | B | 0.360000 | 0.020240 |
| KxGxT | CcCcC | 72.0 | 34.9 | 523.7 | 6.508995 | 6.7535e−11 | 1.00000 | N | 0.137483 | 0.066578 |
| DxDxT | CcCcE | 20.6 | 5.5 | 97.6 | 6.635229 | 7.0133e−11 | 1.00000 | N | 0.211066 | 0.056280 |
| ExGxS | EcCcC | 22.8 | 4.3 | 107.0 | 9.131379 | 8.1828e−11 | 1.00000 | B | 0.213084 | 0.040032 |
| PxHxA | CcHhH | 13.8 | 1.3 | 42.8 | 11.025072 | 8.4644e−11 | 1.00000 | B | 0.322430 | 0.030883 |
| GxLxL | CcCcH | 18.9 | 2.8 | 110.4 | 9.756476 | 8.9145e−11 | 1.00000 | B | 0.171196 | 0.025321 |
| CxGxI | EcCcC | 7.0 | 0.2 | 19.8 | 17.719130 | 9.6238e−11 | 1.00000 | B | 0.353535 | 0.007605 |
| QxQxN | CcCeE | 16.7 | 2.5 | 32.4 | 9.345434 | 1.2978e−10 | 1.00000 | B | 0.515432 | 0.077204 |
| NxGxM | EcCcH | 8.1 | 0.3 | 12.3 | 13.702397 | 1.4709e−10 | 1.00000 | B | 0.658537 | 0.026861 |
| MxLxT | EeCcC | 13.0 | 1.2 | 48.2 | 10.653411 | 2.0738e−10 | 1.00000 | B | 0.269710 | 0.025913 |
| DxNxY | CcCcE | 20.3 | 5.6 | 84.7 | 6.441134 | 2.4504e−10 | 1.00000 | N | 0.239669 | 0.065956 |
| TxKxT | CcHhH | 14.0 | 1.5 | 79.3 | 10.247023 | 3.4869e−10 | 1.00000 | B | 0.176545 | 0.019088 |
| YxHxC | CcCcC | 7.0 | 0.3 | 8.0 | 13.107702 | 4.1509e−10 | 1.00000 | B | 0.875000 | 0.034088 |
| DxPxY | CcCcC | 26.5 | 8.6 | 158.0 | 6.299163 | 4.5765e−10 | 1.00000 | N | 0.167722 | 0.054230 |
| DxGxG | CcCcC | 70.9 | 35.3 | 709.9 | 6.151718 | 6.5827e−10 | 1.00000 | N | 0.099873 | 0.049697 |
| NxTxN | HhChH | 18.4 | 3.3 | 47.3 | 8.623012 | 6.9892e−10 | 1.00000 | B | 0.389006 | 0.069712 |
| PxSxK | CcCcH | 11.8 | 1.0 | 49.0 | 10.999112 | 7.9644e−10 | 1.00000 | B | 0.240816 | 0.020131 |
| AxIxR | CcCcH | 10.8 | 0.8 | 37.9 | 11.351590 | 1.0590e−09 | 1.00000 | B | 0.284960 | 0.020941 |
| CxGxS | CcCcC | 25.9 | 8.3 | 343.1 | 6.157692 | 1.0995e−09 | 1.00000 | N | 0.075488 | 0.024300 |
| TxPxG | EcCcC | 38.8 | 15.5 | 285.9 | 6.068337 | 1.4435e−09 | 1.00000 | N | 0.135712 | 0.054349 |
| GxLxH | CcCeE | 13.8 | 1.7 | 43.6 | 9.388972 | 2.2415e−09 | 1.00000 | B | 0.316514 | 0.039512 |
| NxGxH | EcCcE | 11.7 | 1.1 | 56.8 | 10.371446 | 2.9851e−09 | 1.00000 | B | 0.205986 | 0.018848 |
| GxVxK | CcCcH | 18.9 | 3.5 | 160.1 | 8.403678 | 3.7537e−09 | 1.00000 | B | 0.118051 | 0.021569 |
| DxLxA | HhCcH | 14.8 | 2.1 | 66.2 | 9.025764 | 3.9660e−09 | 1.00000 | B | 0.223565 | 0.031075 |
| VxKxA | CcHhH | 16.4 | 2.5 | 126.8 | 8.768982 | 4.4341e−09 | 1.00000 | B | 0.129338 | 0.020086 |
| TxAxK | CcCcH | 11.1 | 1.1 | 35.8 | 9.811276 | 4.5969e−09 | 1.00000 | B | 0.310056 | 0.030060 |
| VxPxY | EcCcC | 20.4 | 4.2 | 105.4 | 8.032775 | 4.7842e−09 | 1.00000 | B | 0.193548 | 0.040079 |
| NxGxM | HcCcH | 6.6 | 0.2 | 7.8 | 13.426233 | 5.8155e−09 | 1.00000 | B | 0.846154 | 0.029725 |
| KxNxY | EeCcC | 10.3 | 1.1 | 16.6 | 9.184465 | 8.7789e−09 | 1.00000 | B | 0.620482 | 0.064951 |

TABLE 14-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| NxFxV | HcCcH | 6.3 | 0.2 | 8.0 | 12.666549 | 1.2366e−08 | 1.00000 | B | 0.787500 | 0.029519 |
| GxSxL | EeEcC | 7.0 | 0.3 | 22.8 | 12.325790 | 1.2828e−08 | 1.00000 | B | 0.307018 | 0.013134 |
| CxSxW | CeChH | 4.9 | 0.0 | 37.1 | 23.296904 | 1.3101e−08 | 1.00000 | B | 0.132075 | 0.001173 |
| LxPxE | CcChH | 21.8 | 7.1 | 105.6 | 5.746143 | 1.4179e−08 | 1.00000 | N | 0.206439 | 0.066814 |
| CxQxT | CcEeE | 11.5 | 1.3 | 36.0 | 9.258328 | 1.4559e−08 | 1.00000 | B | 0.319444 | 0.035176 |
| SxSxN | CcChH | 18.1 | 5.3 | 85.1 | 5.748142 | 1.6594e−08 | 1.00000 | N | 0.212691 | 0.062200 |
| QxRxY | CcCcH | 7.8 | 0.5 | 10.1 | 10.639154 | 1.7285e−08 | 1.00000 | B | 0.772277 | 0.049077 |
| CxAxH | ChHhH | 9.0 | 0.7 | 37.3 | 10.163442 | 1.9366e−08 | 1.00000 | B | 0.241287 | 0.018291 |
| NxGxS | CcChH | 14.8 | 2.4 | 58.5 | 8.220381 | 2.1270e−08 | 1.00000 | B | 0.252991 | 0.040678 |
| LxFxI | CcEeE | 10.2 | 0.9 | 64.5 | 9.774234 | 2.1939e−08 | 1.00000 | B | 0.158140 | 0.014191 |
| NxQxQ | CcCcC | 26.5 | 9.7 | 142.4 | 5.615982 | 2.5284e−08 | 1.00000 | N | 0.186096 | 0.067789 |
| LxVxY | CcCeE | 9.4 | 0.8 | 32.2 | 9.906317 | 3.0929e−08 | 1.00000 | B | 0.291925 | 0.024115 |
| AxIxR | CcChH | 8.3 | 0.5 | 27.6 | 10.629105 | 3.0952e−08 | 1.00000 | B | 0.300725 | 0.019683 |
| PxVxK | CcCcH | 13.5 | 1.9 | 84.7 | 8.381770 | 4.1718e−08 | 1.00000 | B | 0.159386 | 0.022965 |
| GxWxT | CcEcC | 9.5 | 0.9 | 21.6 | 9.360565 | 4.2598e−08 | 1.00000 | B | 0.439815 | 0.040902 |
| SxGxN | HcCcC | 25.3 | 9.2 | 143.6 | 5.513759 | 4.5713e−08 | 1.00000 | N | 0.176184 | 0.063763 |
| KxWxE | CcHhH | 18.1 | 5.5 | 80.6 | 5.559426 | 4.6811e−08 | 1.00000 | N | 0.224566 | 0.068327 |
| HxGxI | EcCcE | 8.9 | 0.7 | 23.9 | 9.773384 | 4.7466e−08 | 1.00000 | B | 0.372385 | 0.030209 |
| GxDxS | CcChH | 35.0 | 14.7 | 228.2 | 5.462292 | 4.9765e−08 | 1.00000 | N | 0.153374 | 0.064532 |
| DxGxT | CcChH | 14.4 | 2.3 | 86.8 | 8.053573 | 5.0224e−08 | 1.00000 | B | 0.165899 | 0.026657 |
| ExCxL | EcCcC | 7.0 | 0.4 | 14.6 | 10.508475 | 5.2940e−08 | 1.00000 | B | 0.479452 | 0.027746 |
| QxLxR | HhCeE | 6.0 | 0.2 | 5.5 | 12.663540 | 5.3355e−08 | 1.00000 | B | 1.090909 | 0.033159 |

TABLE 15

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxGKS | CcCHH | 76.8 | 5.7 | 258.3 | 30.117905 | 8.1947e−197 | 1.00000 | N | 0.297329 | 0.022063 |
| GxGKT | CcCHH | 71.0 | 7.8 | 333.8 | 22.901721 | 1.4036e−114 | 1.00000 | N | 0.212702 | 0.023362 |
| AxKTT | CcHHH | 30.3 | 0.5 | 54.5 | 43.761508 | 1.2949e−47 | 1.00000 | B | 0.555963 | 0.008600 |
| DxAGK | CcCCH | 22.0 | 0.2 | 41.3 | 47.793028 | 8.6206e−40 | 1.00000 | B | 0.532688 | 0.005059 |
| TxVDK | EeEEE | 90.0 | 25.8 | 396.0 | 13.077707 | 8.3835e−39 | 1.00000 | N | 0.227273 | 0.065121 |
| TxTGK | CcCCH | 29.5 | 1.0 | 40.8 | 28.771739 | 5.4168e−38 | 1.00000 | B | 0.723039 | 0.024647 |
| SxKVD | CeEEE | 63.6 | 15.5 | 231.4 | 12.646853 | 3.0755e−36 | 1.00000 | N | 0.274849 | 0.066994 |
| SxVGK | CcCCH | 23.3 | 0.5 | 68.7 | 32.580886 | 2.7209e−32 | 1.00000 | B | 0.339156 | 0.007184 |
| KxDKK | EeEEE | 72.2 | 22.8 | 341.6 | 10.701700 | 1.5998e−26 | 1.00000 | N | 0.211358 | 0.066796 |
| VxCKN | EcCCC | 27.9 | 1.9 | 55.4 | 19.445212 | 3.8832e−26 | 1.00000 | B | 0.503610 | 0.033503 |
| SxKTT | CcHHH | 19.7 | 0.5 | 60.3 | 28.032814 | 5.4204e−26 | 1.00000 | B | 0.326700 | 0.007862 |
| GxTNS | CcHHH | 24.7 | 1.5 | 42.7 | 19.671101 | 6.3209e−25 | 1.00000 | B | 0.578454 | 0.034045 |
| NxACK | EeCCC | 24.2 | 1.7 | 45.0 | 17.623350 | 9.2961e−23 | 1.00000 | B | 0.537778 | 0.037658 |
| SxTKV | HcEEE | 63.7 | 20.9 | 316.4 | 9.703558 | 4.3917e−22 | 1.00000 | N | 0.201327 | 0.065941 |
| AxIGR | CcCCH | 9.7 | 0.0 | 16.7 | 57.885963 | 6.0124e−22 | 1.00000 | B | 0.580838 | 0.001675 |
| NxGKT | CcCHH | 19.3 | 0.9 | 37.9 | 20.057542 | 9.8345e−21 | 1.00000 | B | 0.509235 | 0.022811 |
| SxKST | CcHHH | 19.2 | 0.8 | 76.4 | 21.405193 | 1.4297e−21 | 1.00000 | B | 0.251309 | 0.009821 |
| QxGKT | CcCHH | 18.3 | 1.0 | 26.2 | 17.901767 | 1.8566e−20 | 1.00000 | B | 0.698473 | 0.037136 |
| TxNIG | EeCCC | 15.3 | 0.4 | 13.6 | 20.474271 | 6.1792e−20 | 1.00000 | B | 1.125000 | 0.031424 |
| VxKSS | CcHHH | 15.0 | 0.4 | 39.5 | 22.555376 | 6.7674e−20 | 1.00000 | B | 0.379747 | 0.010689 |
| VxKTS | CcHHH | 15.5 | 0.4 | 39.6 | 22.701630 | 7.4836e−20 | 1.00000 | B | 0.391414 | 0.011232 |
| GxGLG | CcCHH | 13.3 | 0.3 | 18.5 | 23.108179 | 1.2849e−19 | 1.00000 | B | 0.718919 | 0.017353 |
| CxAGI | CcCCC | 10.8 | 0.1 | 24.5 | 35.991458 | 1.9508e−19 | 1.00000 | B | 0.440816 | 0.003628 |
| SxTGN | CcCCH | 15.2 | 0.5 | 13.6 | 18.979056 | 4.1390e−19 | 1.00000 | B | 1.117647 | 0.036383 |
| CxGNI | EcCCC | 7.0 | 0.0 | 12.0 | 65.388018 | 5.6234e−19 | 1.00000 | B | 0.583333 | 0.000953 |
| AxGRT | HcCCC | 20.9 | 1.8 | 39.1 | 14.657288 | 6.6192e−18 | 1.00000 | B | 0.534527 | 0.045587 |
| NxLFV | CcCEE | 2.0 | 0.1 | 2.0 | 6.867619 | 1.7331e−17 | 1.00000 | B | 1.000000 | 0.040680 |
| RxTDV | CcCCH | 3.0 | 0.1 | 2.0 | 5.982392 | 2.2260e−17 | 1.00000 | B | 1.500000 | 0.052925 |
| VxKSA | CcHHH | 12.4 | 0.3 | 50.8 | 23.682682 | 2.9348e−17 | 1.00000 | B | 0.244094 | 0.005196 |
| YxSGR | HhCCC | 18.3 | 1.4 | 32.2 | 14.636474 | 6.2283e−17 | 1.00000 | B | 0.568323 | 0.043307 |
| QxTYS | CcCEE | 1.7 | 0.1 | 1.0 | 3.973058 | 1.0441e−16 | 1.00000 | B | 1.700000 | 0.059576 |
| HxASV | EeEEC | 3.0 | 0.1 | 1.0 | 4.165174 | 1.0497e−16 | 1.00000 | B | 3.000000 | 0.054500 |
| KxVHA | HcHHH | 1.0 | 0.0 | 1.0 | 4.757945 | 1.0633e−16 | 1.00000 | B | 1.000000 | 0.042305 |
| NxPKC | CcCCC | 1.0 | 0.0 | 1.0 | 4.879347 | 1.0655e−16 | 1.00000 | B | 1.000000 | 0.040310 |
| SxNTY | EhHHH | 1.0 | 0.0 | 1.0 | 5.471530 | 1.0743e−16 | 1.00000 | B | 1.000000 | 0.032323 |
| DxRFV | CcCCE | 1.0 | 0.0 | 1.0 | 5.693042 | 1.0770e−16 | 1.00000 | B | 1.000000 | 0.029931 |
| GxRDN | CcEEE | 1.0 | 0.0 | 1.0 | 7.131346 | 1.0888e−16 | 1.00000 | B | 1.000000 | 0.019284 |
| PxYAS | CeEEC | 1.0 | 0.0 | 1.0 | 7.330621 | 1.0899e−16 | 1.00000 | B | 1.000000 | 0.018269 |
| NxKVD | CeEEE | 34.1 | 9.4 | 138.3 | 8.361157 | 1.2840e−16 | 1.00000 | N | 0.246565 | 0.067811 |
| AxIGR | CcCHH | 7.3 | 0.0 | 20.2 | 44.635958 | 3.9779e−16 | 1.00000 | B | 0.361386 | 0.001316 |
| KxVAC | EeECC | 17.6 | 1.4 | 42.0 | 14.190491 | 2.2162e−15 | 1.00000 | B | 0.419048 | 0.032325 |
| RxSET | EeCCC | 13.5 | 0.6 | 32.5 | 16.822086 | 4.6601e−15 | 1.00000 | B | 0.415385 | 0.018436 |
| PxSGK | CcCCH | 11.0 | 0.3 | 33.9 | 18.247326 | 2.6524e−14 | 1.00000 | B | 0.324484 | 0.010162 |
| QxKEG | HhHHC | 24.5 | 3.8 | 61.1 | 10.933736 | 4.3327e−14 | 1.00000 | B | 0.400982 | 0.062470 |
| QxNTN | CeCCC | 17.4 | 1.8 | 28.1 | 11.884158 | 5.1239e−14 | 1.00000 | B | 0.619217 | 0.065309 |
| CxGDS | CcCCC | 15.2 | 0.9 | 207.8 | 14.779991 | 6.0370e−14 | 1.00000 | B | 0.073147 | 0.004503 |

TABLE 15-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxTDW | EeCCC | 9.1 | 0.3 | 9.4 | 16.644901 | 6.1205e-14 | 1.00000 | B | 0.968085 | 0.030755 |
| LxNIC | CcCCC | 6.0 | 0.0 | 9.0 | 35.855552 | 7.2836e-14 | 1.00000 | B | 0.666667 | 0.003092 |
| MxLCT | EeCCC | 8.0 | 0.1 | 11.1 | 21.256674 | 1.0538e-13 | 1.00000 | B | 0.720721 | 0.012478 |
| GxLAH | CcCEE | 12.8 | 0.6 | 32.0 | 15.555407 | 1.0819e-13 | 1.00000 | B | 0.400000 | 0.019525 |
| PxWNI | CeECC | 12.3 | 0.3 | 9.3 | 16.048196 | 1.1558e-13 | 1.00000 | B | 1.322581 | 0.034852 |
| TxCGV | CcEEE | 5.3 | 0.0 | 5.0 | 42.614482 | 1.5607e-13 | 1.00000 | B | 1.060000 | 0.002746 |
| MxTFK | HcCCC | 9.5 | 0.3 | 10.7 | 17.091968 | 1.6743e-13 | 1.00000 | B | 0.887850 | 0.027865 |
| TxKTF | CcHHH | 8.0 | 0.1 | 10.8 | 20.437125 | 1.6991e-13 | 1.00000 | B | 0.740741 | 0.013854 |
| AxVGR | CcCHH | 8.3 | 0.1 | 21.0 | 23.322674 | 1.9270e-13 | 1.00000 | B | 0.395238 | 0.005887 |
| GxICR | CcCCH | 5.0 | 0.0 | 10.7 | 51.742841 | 1.9290e-13 | 1.00000 | B | 0.467290 | 0.000870 |
| RxLGR | CcHHH | 7.0 | 0.1 | 7.5 | 21.419092 | 3.3098e-13 | 1.00000 | B | 0.933333 | 0.014013 |
| QxPNR | HcHHH | 17.2 | 1.8 | 47.4 | 11.863888 | 4.3286e-13 | 1.00000 | B | 0.362869 | 0.037114 |
| AxKNG | CcCCC | 22.6 | 3.5 | 59.6 | 10.545781 | 4.7755e-13 | 1.00000 | B | 0.379195 | 0.058531 |
| QxIMS | CcHHH | 5.0 | 0.0 | 5.0 | 36.712563 | 6.8672e-13 | 1.00000 | B | 1.000000 | 0.003693 |
| GxVGK | CcCCH | 14.6 | 1.0 | 107.2 | 13.322350 | 1.6400e-12 | 1.00000 | B | 0.136194 | 0.009752 |
| PxVGK | CcCCH | 12.0 | 0.6 | 51.9 | 14.216855 | 1.7503e-12 | 1.00000 | B | 0.231214 | 0.012444 |
| SxSGK | CcCCH | 7.7 | 0.1 | 25.4 | 24.456096 | 1.8641e-12 | 1.00000 | B | 0.303150 | 0.003820 |
| NxGKS | CcCHH | 12.5 | 0.7 | 33.0 | 13.743835 | 2.1757e-12 | 1.00000 | B | 0.378788 | 0.022670 |
| CxGCH | ChHHH | 9.4 | 0.3 | 12.7 | 15.666301 | 2.1818e-12 | 1.00000 | B | 0.740157 | 0.027045 |
| QxVGK | CcCCH | 5.0 | 0.0 | 10.0 | 39.581665 | 2.5288e-12 | 1.00000 | B | 0.500000 | 0.001588 |
| SxGIG | CcCCH | 5.9 | 0.0 | 23.8 | 38.855311 | 3.3879e-12 | 1.00000 | B | 0.247899 | 0.000962 |
| DxGVG | CcCCC | 17.9 | 2.1 | 85.4 | 11.043562 | 5.6770e-12 | 1.00000 | B | 0.209602 | 0.024576 |
| GxTVE | CeEEE | 19.5 | 2.9 | 45.9 | 10.091362 | 6.2818e-12 | 1.00000 | B | 0.424837 | 0.062984 |
| SxGVG | CcCCH | 7.7 | 0.1 | 25.5 | 22.270296 | 6.6754e-12 | 1.00000 | B | 0.301961 | 0.004568 |
| HxLAV | EeEEE | 5.0 | 0.0 | 10.7 | 35.885329 | 7.3464e-12 | 1.00000 | B | 0.467290 | 0.001804 |
| VxKSN | CcHHH | 6.3 | 0.1 | 11.0 | 25.731736 | 7.6458e-12 | 1.00000 | B | 0.572727 | 0.005376 |
| TxAGK | CcCCH | 9.1 | 0.3 | 20.0 | 15.689912 | 8.4739e-12 | 1.00000 | B | 0.455000 | 0.015917 |
| DxGKT | CcCHH | 10.5 | 0.5 | 43.6 | 14.602866 | 2.0076e-11 | 1.00000 | B | 0.240826 | 0.010926 |
| NxGYH | EcCCE | 11.7 | 0.7 | 37.8 | 13.208215 | 2.2537e-11 | 1.00000 | B | 0.309524 | 0.018678 |
| PxGPP | CcCCC | 18.4 | 2.7 | 56.0 | 9.854107 | 3.9241e-11 | 1.00000 | B | 0.328571 | 0.047758 |
| CxSCW | CeCHH | 4.9 | 0.0 | 28.3 | 47.000314 | 4.6279e-11 | 1.00000 | B | 0.173145 | 0.000383 |
| RxRPF | EeCCC | 7.5 | 0.2 | 7.0 | 14.155047 | 4.9950e-11 | 1.00000 | B | 1.071429 | 0.033757 |
| NxTPN | HhCHH | 18.4 | 2.8 | 46.3 | 9.571722 | 5.2061e-11 | 1.00000 | B | 0.397408 | 0.060928 |
| QxSGK | CcCCH | 8.2 | 0.3 | 19.9 | 15.915318 | 5.6650e-11 | 1.00000 | B | 0.412060 | 0.012692 |
| TxKFY | CcCEC | 8.0 | 0.3 | 9.5 | 13.315750 | 5.8205e-11 | 1.00000 | B | 0.842105 | 0.036110 |
| SxGNT | CcCHH | 8.0 | 0.3 | 12.7 | 13.715844 | 1.4847e-10 | 1.00000 | B | 0.629921 | 0.025318 |
| CxSCW | CcCHH | 4.6 | 0.0 | 33.7 | 45.330484 | 1.5256e-10 | 1.00000 | B | 0.136499 | 0.000304 |
| TxKTT | CcHHH | 10.0 | 0.5 | 49.2 | 12.893235 | 1.5785e-10 | 1.00000 | B | 0.203252 | 0.011055 |
| NxGLG | CcCHH | 8.0 | 0.1 | 6.1 | 16.168152 | 1.6728e-10 | 1.00000 | B | 1.311475 | 0.022969 |
| YxTMS | CcCEE | 11.7 | 0.8 | 42.8 | 11.916591 | 1.8497e-10 | 1.00000 | B | 0.273364 | 0.019773 |
| FxRIL | CcCCC | 8.8 | 0.4 | 17.8 | 14.255412 | 1.9039e-10 | 1.00000 | B | 0.494382 | 0.020107 |
| QxGSC | CcCCH | 7.5 | 0.2 | 20.2 | 17.095416 | 2.0620e-10 | 1.00000 | B | 0.371287 | 0.009148 |
| IxNYT | EcCCC | 9.6 | 0.4 | 48.0 | 13.897106 | 2.2756e-10 | 1.00000 | B | 0.200000 | 0.009137 |
| KxVNT | CcEEE | 10.5 | 0.6 | 64.8 | 12.844695 | 2.6279e-10 | 1.00000 | B | 0.162037 | 0.009254 |
| PxMNR | CcCCH | 7.9 | 0.3 | 9.0 | 13.625788 | 2.6767e-10 | 1.00000 | B | 0.877778 | 0.035649 |
| FxYSQ | CcCCC | 8.2 | 0.5 | 8.0 | 10.849473 | 2.6899e-10 | 1.00000 | B | 1.025000 | 0.063638 |
| LxVGM | CeEEE | 3.5 | 0.0 | 7.0 | 82.843231 | 2.8933e-10 | 1.00000 | B | 0.500000 | 0.000255 |
| AxGKT | CcCHH | 17.5 | 2.5 | 101.1 | 9.616395 | 2.9615e-10 | 1.00000 | B | 0.173096 | 0.024688 |
| GxTGK | CcCCH | 8.0 | 0.3 | 35.0 | 14.675535 | 3.1693e-10 | 1.00000 | B | 0.228571 | 0.007972 |
| KxNNY | EeCCC | 9.2 | 0.5 | 8.5 | 11.373392 | 3.3783e-10 | 1.00000 | B | 1.082353 | 0.061659 |
| YxHFC | CcCCC | 6.0 | 0.2 | 6.0 | 13.955900 | 7.1245e-10 | 1.00000 | B | 1.000000 | 0.029885 |
| QxQCG | CcCCC | 8.4 | 0.3 | 27.1 | 13.832080 | 7.5500e-10 | 1.00000 | B | 0.309963 | 0.012679 |
| QxRGY | CcCCH | 7.8 | 0.3 | 9.1 | 13.087877 | 7.7131e-10 | 1.00000 | B | 0.857143 | 0.037102 |

TABLE 16

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| SGxxT | CChhH | 50.1 | 5.4 | 204.2 | 19.480512 | 5.5365e-83 | 1.00000 | N | 0.245348 | 0.026478 |
| YHxxN | HHhhH | 50.5 | 6.5 | 81.8 | 18.012634 | 3.0622e-71 | 1.00000 | N | 0.617359 | 0.079280 |
| NKxxL | ECccC | 51.0 | 6.6 | 166.5 | 17.606843 | 3.5567e-68 | 1.00000 | N | 0.306306 | 0.039743 |
| AGxxT | CChhH | 48.1 | 6.2 | 185.3 | 17.110741 | 2.0133e-64 | 1.00000 | N | 0.259579 | 0.033476 |
| HExxH | HHhhH | 53.2 | 3.1 | 231.0 | 28.733287 | 2.3099e-48 | 1.00000 | B | 0.230303 | 0.013348 |
| ACxxG | CCccC | 42.2 | 6.3 | 122.4 | 14.733487 | 3.9997e-48 | 1.00000 | N | 0.344771 | 0.051214 |
| VIxxW | CChhH | 27.8 | 0.4 | 36.0 | 41.212009 | 5.6053e-45 | 1.00000 | B | 0.772222 | 0.012391 |
| TGxxK | CCccH | 38.5 | 6.6 | 151.0 | 12.684841 | 4.4532e-36 | 1.00000 | N | 0.254967 | 0.043773 |
| GVxxS | CCchH | 55.7 | 13.3 | 271.0 | 11.955548 | 1.6382e-32 | 1.00000 | N | 0.205535 | 0.048905 |
| QDxxG | HHHhH | 41.1 | 8.7 | 96.0 | 11.495017 | 5.3755e-30 | 1.00000 | N | 0.428252 | 0.090888 |
| EExxR | HHhhH | 314.5 | 174.2 | 1989.2 | 11.126843 | 7.2386e-29 | 1.00000 | N | 0.158104 | 0.087580 |
| NFxxL | HHhhH | 42.8 | 5.0 | 298.3 | 17.058911 | 3.0896e-26 | 1.00000 | B | 0.143480 | 0.016745 |
| VGxxS | CChhH | 33.7 | 3.0 | 132.7 | 17.980865 | 2.6985e-25 | 1.00000 | B | 0.253956 | 0.022495 |
| LSxxE | CChhH | 117.4 | 48.7 | 851.8 | 10.137582 | 3.9929e-24 | 1.00000 | N | 0.137826 | 0.057178 |
| FPxxL | HHhhH | 39.1 | 9.1 | 187.5 | 10.217915 | 4.6988e-24 | 1.00000 | N | 0.208533 | 0.048396 |

TABLE 16-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GFxxS | CChhH | 27.0 | 2.0 | 67.8 | 18.155159 | 5.3814e-24 | 1.00000 | B | 0.398230 | 0.028894 |
| SGxxK | CCccH | 36.9 | 8.3 | 196.7 | 10.104654 | 1.5766e-23 | 1.00000 | N | 0.187595 | 0.042407 |
| EAxxA | HHhhH | 202.1 | 104.3 | 2020.6 | 9.828707 | 6.9670e-23 | 1.00000 | N | 0.100020 | 0.051634 |
| RRxxE | HHhhH | 190.5 | 98.6 | 1055.7 | 9.717855 | 2.1236e-22 | 1.00000 | N | 0.180449 | 0.093412 |
| LSxxY | HHhhH | 44.5 | 11.7 | 344.0 | 9.754079 | 3.7941e-22 | 1.00000 | N | 0.129360 | 0.034022 |
| GLxxW | EEccC | 12.6 | 0.2 | 19.4 | 30.324768 | 5.5134e-21 | 1.00000 | B | 0.649485 | 0.008738 |
| TKxxK | EEeeE | 96.0 | 39.8 | 398.3 | 9.392073 | 6.4809e-21 | 1.00000 | N | 0.241024 | 0.099903 |
| DExxR | HHhhH | 151.9 | 74.7 | 886.6 | 9.330064 | 9.3406e-21 | 1.00000 | N | 0.171329 | 0.084280 |
| AAxxA | HHhhH | 198.7 | 105.9 | 3428.0 | 9.159010 | 4.1321e-20 | 1.00000 | N | 0.057964 | 0.030896 |
| MNxxE | CChhH | 44.6 | 13.0 | 167.5 | 9.123343 | 1.3666e-19 | 1.00000 | N | 0.266269 | 0.077633 |
| EGxxY | ECccC | 26.9 | 5.8 | 66.1 | 9.140516 | 2.2564e-19 | 1.00000 | N | 0.406959 | 0.088175 |
| LTxxE | CChhH | 100.6 | 43.5 | 866.0 | 8.873080 | 7.1316e-19 | 1.00000 | N | 0.116166 | 0.050279 |
| SKxxH | HHhhH | 34.0 | 8.8 | 105.4 | 8.902407 | 1.3189e-18 | 1.00000 | N | 0.322581 | 0.083153 |
| EExxA | HHhhH | 231.4 | 135.1 | 1569.6 | 8.663887 | 3.3802e-18 | 1.00000 | N | 0.147417 | 0.086081 |
| STxxD | CEeeE | 70.3 | 27.5 | 272.3 | 8.618319 | 8.1370e-18 | 1.00000 | N | 0.258171 | 0.100879 |
| VSxxE | CChhH | 56.4 | 19.6 | 340.2 | 8.573591 | 1.3696e-17 | 1.00000 | N | 0.165785 | 0.057539 |
| ARxxA | HHhhH | 122.1 | 58.7 | 1454.9 | 8.445356 | 2.6748e-17 | 1.00000 | N | 0.083923 | 0.040353 |
| NYxxQ | HHhhH | 29.9 | 7.3 | 161.4 | 8.557089 | 2.9366e-17 | 1.00000 | N | 0.185254 | 0.045252 |
| AAxxG | HHhhH | 61.5 | 22.3 | 619.8 | 8.471116 | 3.0525e-17 | 1.00000 | N | 0.099226 | 0.035912 |
| PTxxI | CEecC | 14.3 | 0.7 | 18.8 | 16.909102 | 3.0897e-17 | 1.00000 | B | 0.760638 | 0.035827 |
| AAxxR | HHhhH | 129.8 | 64.3 | 1242.9 | 8.387023 | 4.2884e-17 | 1.00000 | N | 0.104433 | 0.051739 |
| GTxxT | CCchH | 27.9 | 6.6 | 168.1 | 8.420003 | 1.0007e-16 | 1.00000 | N | 0.165973 | 0.039491 |
| VVxxR | CCeeC | 1.0 | 0.1 | 1.0 | 3.359317 | 1.0199e-16 | 1.00000 | B | 1.000000 | 0.081400 |
| QQxxY | HChhH | 1.0 | 0.1 | 1.0 | 3.385522 | 1.0211e-16 | 1.00000 | B | 1.000000 | 0.080245 |
| TQxxK | CCccH | 16.3 | 1.3 | 19.9 | 13.788693 | 1.7270e-16 | 1.00000 | B | 0.819095 | 0.063780 |
| AAxxQ | HHhhH | 100.7 | 46.6 | 848.8 | 8.140927 | 3.6432e-16 | 1.00000 | N | 0.118638 | 0.054957 |
| ERxxM | HHhhE | 17.3 | 1.2 | 36.5 | 14.665548 | 4.8047e-16 | 1.00000 | B | 0.473973 | 0.034006 |
| LSxxQ | CChhH | 60.8 | 22.9 | 428.9 | 8.130612 | 5.1480e-16 | 1.00000 | N | 0.141758 | 0.053451 |
| AExxR | HHhhH | 179.1 | 100.8 | 1506.8 | 8.070792 | 5.3200e-16 | 1.00000 | N | 0.118861 | 0.066910 |
| PExxR | HHhhH | 110.7 | 53.8 | 655.7 | 8.086699 | 5.4810e-16 | 1.00000 | N | 0.168827 | 0.082123 |
| RExxL | HHhhH | 112.2 | 54.5 | 836.4 | 8.083483 | 5.5774e-16 | 1.00000 | N | 0.134146 | 0.065161 |
| VAxxN | ECccC | 25.5 | 6.1 | 95.8 | 8.160134 | 9.3058e-16 | 1.00000 | N | 0.266180 | 0.063248 |
| NExxR | HHhhH | 68.6 | 27.9 | 378.6 | 7.995600 | 1.4251e-15 | 1.00000 | N | 0.181194 | 0.073776 |
| RExxR | HHhhH | 155.0 | 85.2 | 968.1 | 7.921336 | 1.8513e-15 | 1.00000 | N | 0.160107 | 0.087988 |
| SAxxG | CCccH | 18.0 | 1.4 | 74.6 | 14.080334 | 3.0822e-15 | 1.00000 | B | 0.241287 | 0.018959 |
| QFxxN | CEccC | 17.6 | 1.6 | 32.4 | 13.170193 | 6.2448e-15 | 1.00000 | B | 0.543210 | 0.048103 |
| GHxxL | CHhhC | 13.2 | 0.8 | 17.8 | 14.597369 | 6.8060e-15 | 1.00000 | B | 0.741573 | 0.042626 |
| ISxxT | CChhH | 29.2 | 5.0 | 113.2 | 11.136582 | 6.9787e-15 | 1.00000 | B | 0.257951 | 0.043782 |
| PVxxA | HHhhH | 42.9 | 14.1 | 430.6 | 7.802016 | 8.8311e-15 | 1.00000 | N | 0.099628 | 0.032730 |
| PGxxE | CChhH | 48.5 | 17.5 | 230.5 | 7.724590 | 1.4791e-14 | 1.00000 | N | 0.210412 | 0.075770 |
| ASxxT | HCccC | 23.5 | 5.6 | 109.1 | 7.765462 | 2.2008e-14 | 1.00000 | N | 0.215399 | 0.051334 |
| KNxxC | EEecC | 16.4 | 1.3 | 42.0 | 13.547220 | 2.8206e-14 | 1.00000 | B | 0.390476 | 0.030577 |
| CQxxS | CCccC | 22.8 | 5.3 | 160.0 | 7.735656 | 2.8522e-14 | 1.00000 | N | 0.142500 | 0.033098 |
| QTxxR | HChhH | 18.2 | 1.8 | 48.4 | 12.642180 | 2.9192e-14 | 1.00000 | B | 0.376033 | 0.036274 |
| NQxxN | HHchH | 21.5 | 5.1 | 47.3 | 7.729667 | 3.3269e-14 | 1.00000 | N | 0.454545 | 0.107054 |
| FRxxD | HHhhC | 17.5 | 1.4 | 102.5 | 13.730817 | 3.4864e-14 | 1.00000 | B | 0.170732 | 0.013607 |
| AAxxE | HHhhH | 158.9 | 89.7 | 1585.5 | 7.528216 | 3.8940e-14 | 1.00000 | N | 0.100233 | 0.056558 |
| PExxA | HHhhH | 127.9 | 68.2 | 958.9 | 7.506229 | 4.9065e-14 | 1.00000 | N | 0.133382 | 0.071091 |
| RExxA | HHhhH | 122.1 | 64.6 | 824.6 | 7.452817 | 7.4518e-14 | 1.00000 | N | 0.148072 | 0.078335 |
| QTxxT | CCchH | 19.0 | 2.3 | 38.5 | 11.408119 | 7.7838e-14 | 1.00000 | B | 0.493506 | 0.059291 |
| PExxN | HHhhH | 42.6 | 15.0 | 197.4 | 7.430722 | 1.4792e-13 | 1.00000 | N | 0.215805 | 0.075812 |
| PGxxA | CChhH | 28.5 | 8.0 | 157.5 | 7.445140 | 1.8844e-13 | 1.00000 | N | 0.180952 | 0.050747 |
| AQxxS | HHhhH | 50.4 | 19.0 | 360.1 | 7.381135 | 1.8871e-13 | 1.00000 | N | 0.139961 | 0.052899 |
| AExxQ | HHhhH | 100.1 | 50.3 | 642.7 | 7.316766 | 2.1891e-13 | 1.00000 | N | 0.155749 | 0.078242 |
| EDxxY | HHhhH | 34.2 | 10.8 | 168.1 | 7.391077 | 2.3540e-13 | 1.00000 | N | 0.203450 | 0.063963 |
| LPxxV | CChhH | 31.7 | 9.5 | 328.1 | 7.313760 | 4.3680e-13 | 1.00000 | N | 0.096617 | 0.028935 |
| GSxxT | CCchH | 21.7 | 5.2 | 117.5 | 7.361159 | 4.7484e-13 | 1.00000 | N | 0.184681 | 0.044560 |
| GGxxK | CCccH | 24.6 | 6.4 | 146.1 | 7.326094 | 5.2243e-13 | 1.00000 | N | 0.168378 | 0.044029 |
| QAxxD | HHhhH | 99.7 | 50.5 | 702.9 | 7.189078 | 5.5537e-13 | 1.00000 | N | 0.141841 | 0.071827 |
| MNxxD | CChhH | 22.2 | 5.6 | 69.2 | 7.324761 | 6.0496e-13 | 1.00000 | N | 0.320809 | 0.080818 |
| AExxA | HHhhH | 177.1 | 105.6 | 2016.0 | 7.144690 | 6.4810e-13 | 1.00000 | N | 0.087847 | 0.052392 |
| CGxxW | CEchH | 10.4 | 0.3 | 41.6 | 17.562614 | 6.5688e-13 | 1.00000 | B | 0.250000 | 0.007964 |
| AExxS | HHhhH | 69.0 | 30.7 | 525.3 | 7.131241 | 9.7365e-13 | 1.00000 | N | 0.131354 | 0.058394 |
| LAxxS | HHhhH | 111.2 | 58.3 | 1261.6 | 7.088647 | 1.0966e-12 | 1.00000 | N | 0.088142 | 0.046234 |
| YQxxL | HHhhH | 40.1 | 13.9 | 386.6 | 7.155977 | 1.1141e-12 | 1.00000 | N | 0.103725 | 0.035961 |
| GSxxS | CCchH | 23.4 | 6.1 | 129.5 | 7.214135 | 1.2252e-12 | 1.00000 | N | 0.180695 | 0.046800 |
| RSxxE | CChhH | 37.0 | 12.6 | 179.8 | 7.134674 | 1.3888e-12 | 1.00000 | N | 0.205784 | 0.070013 |
| PExxT | HHhhH | 42.2 | 15.3 | 228.7 | 7.116551 | 1.4320e-12 | 1.00000 | N | 0.184521 | 0.066926 |
| RIxxN | HHhhH | 31.3 | 9.7 | 211.7 | 7.132289 | 1.6125e-12 | 1.00000 | N | 0.147851 | 0.045594 |
| ALxxE | HHhhH | 108.9 | 57.0 | 1224.1 | 7.032913 | 1.6407e-12 | 1.00000 | N | 0.088963 | 0.046595 |
| STxxR | HHhhH | 44.8 | 16.8 | 265.4 | 7.068810 | 1.9236e-12 | 1.00000 | N | 0.168802 | 0.063213 |
| SWxxE | EEccC | 20.9 | 5.0 | 179.2 | 7.166893 | 1.9472e-12 | 1.00000 | N | 0.116629 | 0.028121 |
| LGxxI | CCeeE | 20.7 | 2.8 | 133.5 | 10.850496 | 2.8269e-12 | 1.00000 | B | 0.155056 | 0.020856 |
| NVxxK | EEccC | 25.3 | 5.0 | 66.0 | 9.489538 | 2.9209e-12 | 1.00000 | B | 0.383333 | 0.075233 |
| PAxxA | HHhhH | 81.8 | 39.3 | 821.2 | 6.958559 | 3.0611e-12 | 1.00000 | N | 0.099610 | 0.047803 |
| DAxxA | HHhhH | 128.3 | 71.5 | 1234.0 | 6.928395 | 3.2679e-12 | 1.00000 | N | 0.103971 | 0.057905 |
| WGxxC | ECccC | 21.1 | 3.0 | 152.1 | 10.567647 | 3.5349e-12 | 1.00000 | B | 0.138725 | 0.019687 |

TABLE 16-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ISxxE | CChhh | 45.1 | 17.1 | 314.7 | 6.975012 | 3.6776e-12 | 1.00000 | N | 0.143311 | 0.054250 |
| RRxxA | HHhhH | 86.1 | 42.7 | 559.3 | 6.903535 | 4.4287e-12 | 1.00000 | N | 0.153942 | 0.076400 |
| EQxxA | HHhhH | 117.1 | 64.1 | 862.2 | 6.877330 | 4.7983e-12 | 1.00000 | N | 0.135815 | 0.074365 |
| HGxxT | CChhH | 15.0 | 1.4 | 57.6 | 11.717492 | 5.1305e-12 | 1.00000 | B | 0.260417 | 0.024021 |
| ANxxN | HHhhH | 26.8 | 7.9 | 128.3 | 6.978653 | 5.4345e-12 | 1.00000 | N | 0.208885 | 0.061203 |
| ARxxQ | HHhhH | 63.9 | 28.5 | 473.6 | 6.834976 | 8.0075e-12 | 1.00000 | N | 0.134924 | 0.060212 |
| AQxxA | HHhhH | 97.0 | 50.1 | 1116.6 | 6.788691 | 9.3146e-12 | 1.00000 | N | 0.086871 | 0.044831 |

TABLE 17

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| NKxDL | ECcCC | 51.0 | 4.4 | 116.2 | 22.740877 | 5.5464e-41 | 1.00000 | B | 0.438898 | 0.037599 |
| AGxTT | CChhH | 30.4 | 0.9 | 60.4 | 31.071504 | 1.5187e-38 | 1.00000 | B | 0.503311 | 0.015139 |
| TKxDK | EEeEE | 87.3 | 25.2 | 364.3 | 12.810007 | 2.7096e-37 | 1.00000 | N | 0.239638 | 0.069249 |
| GVxKS | CCcHH | 35.9 | 1.9 | 116.9 | 24.813673 | 7.8566e-35 | 1.00000 | B | 0.307100 | 0.016320 |
| STxVD | CEeEE | 66.1 | 17.9 | 259.0 | 11.784220 | 9.9807e-32 | 1.00000 | N | 0.255212 | 0.069278 |
| GFxNS | CChhH | 25.7 | 1.3 | 43.2 | 21.484488 | 2.0443e-27 | 1.00000 | B | 0.594907 | 0.030734 |
| TGxGK | CCcCH | 33.6 | 2.8 | 111.4 | 18.471969 | 3.4400e-26 | 1.00000 | B | 0.301616 | 0.025536 |
| SGxGK | CCcCH | 32.6 | 2.9 | 157.9 | 17.436658 | 6.0866e-24 | 1.00000 | B | 0.206460 | 0.018664 |
| KVxKK | EEeEE | 71.2 | 24.3 | 349.6 | 9.858861 | 8.8905e-23 | 1.00000 | N | 0.203661 | 0.069538 |
| NVxCK | EEcCC | 24.2 | 1.7 | 45.0 | 17.590163 | 1.0058e-22 | 1.00000 | B | 0.537778 | 0.037786 |
| TQxGK | CCcCH | 16.3 | 0.7 | 16.3 | 19.157024 | 2.0483e-22 | 1.00000 | B | 1.000000 | 0.042526 |
| VGxSS | CChhH | 15.0 | 0.4 | 36.0 | 24.399792 | 5.2733e-21 | 1.00000 | B | 0.416667 | 0.010097 |
| AGxGR | CCcHH | 13.2 | 0.2 | 54.5 | 30.666714 | 5.2900e-21 | 1.00000 | B | 0.242202 | 0.003318 |
| QTxKT | CCcHH | 15.3 | 0.6 | 18.2 | 19.806546 | 2.0252e-20 | 1.00000 | B | 0.840659 | 0.031369 |
| CGxCW | CEcHH | 10.1 | 0.1 | 31.8 | 41.150449 | 2.8004e-20 | 1.00000 | B | 0.317610 | 0.001876 |
| ACxNG | CCcCC | 22.7 | 1.7 | 46.9 | 16.272242 | 5.2201e-20 | 1.00000 | B | 0.484009 | 0.036780 |
| CSxGI | CCcCC | 10.8 | 0.1 | 24.3 | 38.141746 | 6.0931e-20 | 1.00000 | B | 0.444444 | 0.003262 |
| GSxKS | CCcHH | 19.6 | 1.1 | 69.1 | 17.909474 | 5.1058e-19 | 1.00000 | B | 0.283647 | 0.015713 |
| SGxST | CChhH | 19.2 | 1.1 | 78.8 | 17.700094 | 9.4319e-19 | 1.00000 | B | 0.243655 | 0.013505 |
| SGxTT | CChhH | 19.7 | 1.2 | 60.8 | 17.285137 | 1.0837e-18 | 1.00000 | B | 0.324013 | 0.019270 |
| TWxIG | EEcCC | 12.3 | 0.4 | 12.3 | 19.628460 | 1.2719e-18 | 1.00000 | B | 1.000000 | 0.030937 |
| GTxKT | CCcHH | 22.0 | 1.7 | 105.1 | 15.901012 | 1.6887e-18 | 1.00000 | B | 0.209324 | 0.015815 |
| YAxGR | HHcHH | 19.2 | 1.4 | 32.9 | 15.460085 | 2.5350e-18 | 1.00000 | B | 0.583587 | 0.042130 |
| LGxSI | CCeEE | 12.5 | 0.2 | 38.3 | 25.478322 | 3.4342e-18 | 1.00000 | B | 0.326371 | 0.006089 |
| SPxSL | ECcEE | 42.9 | 12.8 | 185.7 | 8.740430 | 4.1484e-18 | 1.00000 | N | 0.231018 | 0.068739 |
| VGxTS | CChhH | 15.5 | 0.6 | 40.7 | 18.885040 | 1.3617e-17 | 1.00000 | B | 0.380835 | 0.015473 |
| QFxTN | CEcCC | 17.3 | 1.1 | 28.1 | 15.703799 | 1.4457e-17 | 1.00000 | B | 0.615658 | 0.039391 |
| GTxVV | CCcHH | 4.0 | 0.1 | 2.0 | 6.359524 | 1.9940e-17 | 1.00000 | B | 2.000000 | 0.047121 |
| SAxIG | CCcCH | 7.3 | 0.0 | 20.5 | 53.215652 | 3.5180e-17 | 1.00000 | B | 0.356098 | 0.000914 |
| GLxDW | EEcCC | 9.1 | 0.1 | 11.4 | 26.491413 | 1.0313e-16 | 1.00000 | B | 0.798246 | 0.010192 |
| QQxDY | HChHH | 1.0 | 0.1 | 1.0 | 4.123152 | 1.0485e-16 | 1.00000 | B | 1.000000 | 0.055554 |
| VVxGK | CEeCC | 1.0 | 0.1 | 1.0 | 4.267421 | 1.0524e-16 | 1.00000 | B | 1.000000 | 0.052054 |
| QSxGA | HCcCC | 1.0 | 0.0 | 1.0 | 4.675749 | 1.0617e-16 | 1.00000 | B | 1.000000 | 0.043740 |
| HExEN | EEcCC | 1.0 | 0.0 | 1.0 | 4.702523 | 1.0622e-16 | 1.00000 | B | 1.000000 | 0.043264 |
| FAxKL | EEeCC | 1.5 | 0.0 | 1.0 | 4.717887 | 1.0625e-16 | 1.00000 | B | 1.500000 | 0.042995 |
| ASxNT | CEhHH | 1.0 | 0.0 | 1.0 | 4.998624 | 1.0675e-16 | 1.00000 | B | 1.000000 | 0.038482 |
| DMxIT | HCcCC | 1.0 | 0.0 | 1.0 | 5.018322 | 1.0678e-16 | 1.00000 | B | 1.000000 | 0.038192 |
| YIxIH | EEcCC | 1.5 | 0.0 | 1.0 | 5.296248 | 1.0720e-16 | 1.00000 | B | 1.500000 | 0.034423 |
| TQxHG | ECcCC | 2.0 | 0.0 | 1.0 | 6.082239 | 1.0810e-16 | 1.00000 | B | 2.000000 | 0.026320 |
| GYxDN | CCeEE | 1.0 | 0.0 | 1.0 | 14.344343 | 1.1049e-16 | 1.00000 | B | 1.000000 | 0.004837 |
| QDxEG | HHhhC | 26.0 | 3.7 | 53.3 | 11.934122 | 1.7775e-16 | 1.00000 | B | 0.487805 | 0.070194 |
| DNxGK | CCcCH | 11.3 | 0.3 | 18.0 | 20.870892 | 2.9417e-16 | 1.00000 | B | 0.627778 | 0.015727 |
| SAxVG | CCcCH | 8.5 | 0.1 | 20.4 | 35.031051 | 3.2861e-16 | 1.00000 | B | 0.416667 | 0.002855 |
| ASxRT | HCcCC | 17.7 | 1.4 | 31.9 | 14.276988 | 5.1468e-16 | 1.00000 | B | 0.554859 | 0.042862 |
| SSxKV | HCeEE | 42.6 | 13.8 | 198.0 | 8.026654 | 1.5452e-15 | 1.00000 | N | 0.215152 | 0.069800 |
| GSxKT | CCcHH | 17.5 | 1.3 | 79.1 | 14.243727 | 8.9918e-15 | 1.00000 | B | 0.221239 | 0.016602 |
| PTxNI | CEeCC | 14.3 | 0.4 | 10.3 | 16.216076 | 9.0764e-15 | 1.00000 | B | 1.388350 | 0.037693 |
| GNxCR | CCcCC | 6.5 | 0.0 | 14.5 | 46.467091 | 1.1355e-14 | 1.00000 | B | 0.448276 | 0.001343 |
| PNxGK | CCcCH | 15.0 | 1.0 | 39.3 | 14.390978 | 1.3407e-14 | 1.00000 | B | 0.381679 | 0.024785 |
| GAxKT | CCcHH | 13.6 | 0.6 | 44.4 | 16.519183 | 1.4276e-14 | 1.00000 | B | 0.306306 | 0.014092 |
| KNxAC | EEeCC | 16.4 | 1.3 | 42.0 | 13.642975 | 2.3347e-14 | 1.00000 | B | 0.390476 | 0.030201 |
| QTxNR | HChHH | 17.2 | 1.5 | 46.4 | 12.932319 | 3.8897e-14 | 1.00000 | B | 0.370690 | 0.032756 |
| WGxGC | ECcCC | 20.7 | 2.2 | 129.6 | 12.427477 | 5.4394e-14 | 1.00000 | B | 0.159722 | 0.017317 |
| NAxKT | CCcHH | 9.3 | 0.2 | 15.1 | 20.147303 | 5.9572e-14 | 1.00000 | B | 0.615894 | 0.013678 |
| CLxNI | ECcCC | 6.0 | 0.0 | 9.0 | 35.616030 | 7.8888e-14 | 1.00000 | B | 0.666667 | 0.003134 |
| AAxKT | CCcHH | 9.0 | 0.2 | 19.0 | 20.285697 | 8.6402e-14 | 1.00000 | B | 0.473684 | 0.010026 |
| NTxVD | CEeEE | 32.3 | 9.8 | 136.8 | 7.475662 | 1.3386e-13 | 1.00000 | N | 0.236111 | 0.071465 |
| VGxSA | CChhH | 12.4 | 0.5 | 56.3 | 16.096540 | 1.7662e-13 | 1.00000 | B | 0.220249 | 0.009725 |
| MExCT | EEcCC | 8.0 | 0.1 | 11.1 | 20.524084 | 1.8190e-13 | 1.00000 | B | 0.720721 | 0.013363 |
| RMxTF | HHcCC | 9.5 | 0.3 | 10.7 | 16.898890 | 2.0377e-13 | 1.00000 | B | 0.887850 | 0.028482 |
| QGxMS | CChHH | 7.0 | 0.1 | 7.0 | 21.093959 | 2.1381e-13 | 1.00000 | B | 1.000000 | 0.015488 |

TABLE 17-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| VAxKN | ECcCC | 20.9 | 2.9 | 46.7 | 10.827897 | 2.6347e-13 | 1.00000 | B | 0.447537 | 0.062888 |
| GGxGK | CCcCH | 18.1 | 1.8 | 107.1 | 12.168318 | 3.5653e-13 | 1.00000 | B | 0.169001 | 0.017001 |
| AGxGR | CCcCH | 8.9 | 0.2 | 33.4 | 21.578870 | 5.4421e-13 | 1.00000 | B | 0.266467 | 0.004931 |
| TNxRV | CChHH | 8.3 | 0.2 | 8.4 | 16.373784 | 1.1096e-12 | 1.00000 | B | 0.988095 | 0.029661 |
| NQxPN | HHcHH | 21.5 | 3.4 | 47.3 | 10.210149 | 1.1585e-12 | 1.00000 | B | 0.454545 | 0.071654 |
| IVxYT | ECcCC | 9.3 | 0.3 | 23.0 | 17.597398 | 1.8793e-12 | 1.00000 | B | 0.404348 | 0.011592 |
| GHxAL | CHhHC | 9.9 | 0.4 | 12.9 | 14.873905 | 2.6141e-12 | 1.00000 | B | 0.767442 | 0.032551 |
| TGxTF | CChHH | 8.0 | 0.2 | 9.8 | 16.341229 | 3.1327e-12 | 1.00000 | B | 0.816327 | 0.023619 |
| SSxGN | CCcCH | 8.0 | 0.3 | 8.4 | 14.950912 | 3.5866e-12 | 1.00000 | B | 0.952381 | 0.032853 |
| HNxVN | HHhHH | 6.0 | 0.1 | 7.0 | 23.122716 | 5.0946e-12 | 1.00000 | B | 0.857143 | 0.009497 |
| DAxGK | CCcCH | 9.0 | 0.3 | 20.7 | 16.159672 | 5.1094e-12 | 1.00000 | B | 0.434783 | 0.014223 |
| CGxCW | CCcHH | 6.6 | 0.1 | 35.8 | 27.620962 | 1.0933e-11 | 1.00000 | B | 0.184358 | 0.001570 |
| GSxVE | CEeEE | 15.9 | 2.0 | 34.1 | 10.186491 | 3.2680e-11 | 1.00000 | B | 0.466276 | 0.058124 |
| TFxFY | CCcEC | 8.0 | 0.3 | 9.5 | 13.808045 | 3.3591e-11 | 1.00000 | B | 0.842105 | 0.033698 |
| QGxGL | CCcCH | 8.0 | 0.3 | 12.9 | 15.079061 | 3.7782e-11 | 1.00000 | B | 0.620155 | 0.020813 |
| SAxIG | CCcCC | 11.3 | 0.7 | 34.2 | 12.776025 | 3.8879e-11 | 1.00000 | B | 0.330409 | 0.020540 |
| CSxGV | CCcCC | 7.8 | 0.2 | 26.0 | 18.754611 | 5.5937e-11 | 1.00000 | B | 0.300000 | 0.006412 |
| FMxIL | CCcCC | 8.8 | 0.3 | 17.0 | 14.990622 | 8.1728e-11 | 1.00000 | B | 0.517647 | 0.019165 |
| STxNT | CCcHH | 8.0 | 0.3 | 11.6 | 13.939347 | 8.2850e-11 | 1.00000 | B | 0.689655 | 0.026945 |
| GQxIM | CCcHH | 5.0 | 0.0 | 6.0 | 24.219345 | 1.0267e-10 | 1.00000 | B | 0.833333 | 0.007033 |
| YSxMS | CCcEE | 11.7 | 0.8 | 42.8 | 12.163882 | 1.2625e-10 | 1.00000 | B | 0.273364 | 0.019069 |
| TMxRI | HHhHH | 11.4 | 0.9 | 25.5 | 11.524995 | 1.5721e-10 | 1.00000 | B | 0.447059 | 0.033919 |
| ACxGD | CCcCC | 9.1 | 0.4 | 85.9 | 14.278707 | 1.7497e-10 | 1.00000 | B | 0.105937 | 0.004366 |
| QGxGK | CCcCH | 9.2 | 0.5 | 18.4 | 12.798647 | 2.1515e-10 | 1.00000 | B | 0.500000 | 0.025918 |
| QCxSC | CCcCH | 5.6 | 0.0 | 20.2 | 26.306118 | 3.4094e-10 | 1.00000 | B | 0.277228 | 0.002213 |
| KRxNF | CCcCE | 7.3 | 0.2 | 20.3 | 15.996806 | 4.8000e-10 | 1.00000 | B | 0.359606 | 0.009803 |
| NGxGK | CCcCH | 11.0 | 0.8 | 49.0 | 11.320321 | 4.8018e-10 | 1.00000 | B | 0.224490 | 0.016778 |
| QVxGY | CCcCH | 7.8 | 0.3 | 7.1 | 12.079087 | 5.3401e-10 | 1.00000 | B | 1.098592 | 0.046404 |
| KExHP | HHhCC | 8.5 | 0.5 | 9.3 | 11.568737 | 5.4438e-10 | 1.00000 | B | 0.913978 | 0.054304 |
| RGxGR | CChHH | 8.0 | 0.5 | 10.0 | 11.451342 | 7.5878e-10 | 1.00000 | B | 0.800000 | 0.045482 |
| LTxWK | ECcCC | 6.2 | 0.1 | 10.0 | 16.936775 | 7.8155e-10 | 1.00000 | B | 0.620000 | 0.013013 |
| PGxGK | CCcCH | 19.1 | 3.3 | 118.9 | 8.743858 | 1.0050e-09 | 1.00000 | B | 0.160639 | 0.028106 |
| APxVY | CCeEE | 9.2 | 0.5 | 111.5 | 12.536420 | 1.6006e-09 | 1.00000 | B | 0.082511 | 0.004353 |
| HHxEL | EEeEC | 4.4 | 0.0 | 10.4 | 31.598476 | 1.7714e-09 | 1.00000 | B | 0.423077 | 0.001852 |
| NVxKS | CCcHH | 10.0 | 0.8 | 28.0 | 10.736324 | 1.8455e-09 | 1.00000 | B | 0.357143 | 0.027185 |
| PExLT | HHhHH | 18.8 | 3.4 | 94.8 | 8.545879 | 2.0965e-09 | 1.00000 | B | 0.198312 | 0.035625 |
| QGxCG | CCcCC | 10.6 | 0.8 | 49.9 | 11.223443 | 2.0978e-09 | 1.00000 | B | 0.212425 | 0.015591 |
| HKxQS | HHhCC | 5.3 | 0.1 | 7.1 | 19.188490 | 2.1092e-09 | 1.00000 | B | 0.746479 | 0.010555 |

TABLE 18

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| AGKxT | CCHhH | 45.2 | 1.2 | 109.0 | 40.761894 | 1.3250e-58 | 1.00000 | B | 0.414679 | 0.010817 |
| SGKxT | CCHhH | 44.9 | 1.2 | 149.1 | 39.478589 | 1.6432e-55 | 1.00000 | B | 0.301140 | 0.008274 |
| VGKxS | CCHhH | 30.5 | 0.4 | 78.0 | 49.113385 | 5.0372e-49 | 1.00000 | B | 0.391026 | 0.004846 |
| TKVxK | EEEeE | 92.3 | 24.5 | 367.4 | 14.170064 | 3.0926e-45 | 1.00000 | N | 0.251225 | 0.066733 |
| STKxD | CEEeE | 64.9 | 15.7 | 230.1 | 12.882989 | 1.5164e-37 | 1.00000 | N | 0.282051 | 0.068100 |
| ACKxG | CCCcC | 34.1 | 2.0 | 46.4 | 23.183661 | 1.3729e-36 | 1.00000 | B | 0.734914 | 0.043173 |
| GVGxS | CCChH | 36.4 | 2.9 | 125.7 | 19.900725 | 3.7374e-29 | 1.00000 | B | 0.289578 | 0.023075 |
| GFTxS | CCHhH | 25.7 | 1.3 | 42.2 | 21.824769 | 7.8086e-28 | 1.00000 | B | 0.609005 | 0.030577 |
| CSAxI | CCCcC | 13.3 | 0.1 | 22.7 | 43.660373 | 4.7467e-26 | 1.00000 | B | 0.585903 | 0.004048 |
| KVDxK | EEEeE | 71.7 | 23.7 | 345.2 | 10.223365 | 2.3244e-24 | 1.00000 | N | 0.207706 | 0.068609 |
| QTGxT | CCChH | 19.0 | 0.8 | 22.9 | 20.352647 | 2.5890e-24 | 1.00000 | B | 0.829694 | 0.036120 |
| VACxN | ECCcC | 21.9 | 1.3 | 45.0 | 18.018290 | 2.2608e-21 | 1.00000 | B | 0.486667 | 0.029818 |
| SAGxG | CCCcH | 15.4 | 0.3 | 53.5 | 25.919968 | 3.9071e-21 | 1.00000 | B | 0.287850 | 0.006351 |
| TGTxK | CCCcH | 13.2 | 0.3 | 24.9 | 24.228491 | 2.1996e-19 | 1.00000 | B | 0.530120 | 0.011540 |
| TQTxK | CCCcH | 15.3 | 0.6 | 14.3 | 17.434283 | 2.3536e-19 | 1.00000 | B | 1.069930 | 0.044933 |
| SGVxK | CCCcH | 18.3 | 0.9 | 60.9 | 18.724382 | 3.6394e-19 | 1.00000 | B | 0.300493 | 0.014423 |
| GSGxS | CCChH | 19.9 | 1.3 | 77.0 | 16.792109 | 3.0892e-18 | 1.00000 | B | 0.258442 | 0.016279 |
| GTGxT | CCChH | 26.9 | 2.9 | 127.9 | 14.224851 | 3.5090e-18 | 1.00000 | B | 0.210321 | 0.022755 |
| GLTxW | EECcC | 9.1 | 0.1 | 9.4 | 28.802900 | 3.8894e-18 | 1.00000 | B | 0.968085 | 0.010500 |
| NVAxK | EECcC | 24.2 | 2.7 | 48.5 | 13.323932 | 1.1195e-17 | 1.00000 | B | 0.498969 | 0.056658 |
| NAGxT | CCChH | 9.3 | 0.1 | 14.9 | 32.073501 | 1.6197e-17 | 1.00000 | B | 0.624161 | 0.005573 |
| QDKxG | HHHhC | 27.2 | 3.9 | 57.3 | 12.295135 | 4.3110e-17 | 1.00000 | B | 0.474695 | 0.067418 |
| QSPxS | EECcE | 30.2 | 7.5 | 200.3 | 8.450279 | 7.0338e-17 | 1.00000 | N | 0.150774 | 0.037434 |
| QFNxN | CECcC | 17.1 | 1.2 | 28.1 | 14.748204 | 8.3663e-17 | 1.00000 | B | 0.608541 | 0.043159 |
| HTFxD | ECCcC | 1.0 | 0.1 | 1.0 | 4.054249 | 1.0466e-16 | 1.00000 | B | 1.000000 | 0.057350 |
| HIAxV | EEEeC | 3.0 | 0.1 | 1.0 | 4.139053 | 1.0490e-16 | 1.00000 | B | 3.000000 | 0.055152 |
| NKNxE | EECcC | 1.5 | 0.0 | 1.0 | 4.392794 | 1.0555e-16 | 1.00000 | B | 1.500000 | 0.049269 |
| KRSxA | HHCcC | 1.0 | 0.0 | 1.0 | 4.431513 | 1.0564e-16 | 1.00000 | B | 1.000000 | 0.048454 |
| FADxL | EEEcC | 1.5 | 0.0 | 1.0 | 4.615996 | 1.0605e-16 | 1.00000 | B | 1.500000 | 0.044828 |
| HESxN | EECcC | 1.0 | 0.0 | 1.0 | 4.763003 | 1.0634e-16 | 1.00000 | B | 1.000000 | 0.042219 |

TABLE 18-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| DASxN | CCEhH | 1.0 | 0.0 | 1.0 | 5.499204 | 1.0747e-16 | 1.00000 | B | 1.000000 | 0.032009 |
| EYFxE | HHHcC | 1.0 | 0.0 | 1.0 | 6.536892 | 1.0848e-16 | 1.00000 | B | 1.000000 | 0.022867 |
| SLFxE | CCHhH | 1.0 | 0.0 | 1.0 | 8.213495 | 1.0940e-16 | 1.00000 | B | 1.000000 | 0.014607 |
| GYRxN | CCEeE | 1.0 | 0.0 | 1.0 | 13.413602 | 1.1041e-16 | 1.00000 | B | 1.000000 | 0.005527 |
| DNAxK | CCCcH | 9.3 | 0.1 | 13.0 | 26.378846 | 2.7763e-16 | 1.00000 | B | 0.715385 | 0.009400 |
| SSTxV | HCEeE | 44.7 | 14.5 | 217.1 | 8.214938 | 3.2657e-16 | 1.00000 | N | 0.205896 | 0.066745 |
| TGKxT | CCHhH | 13.0 | 0.4 | 60.8 | 19.353824 | 4.3808e-16 | 1.00000 | B | 0.213816 | 0.006992 |
| YASxR | HHCcC | 17.3 | 1.3 | 31.5 | 14.260402 | 5.2564e-16 | 1.00000 | B | 0.549206 | 0.041639 |
| VGKxA | CCHhH | 13.4 | 0.5 | 59.3 | 17.711339 | 4.4786e-15 | 1.00000 | B | 0.225970 | 0.008981 |
| TKMxF | CCCcC | 13.9 | 0.9 | 20.0 | 14.318899 | 1.3175e-14 | 1.00000 | B | 0.695000 | 0.043304 |
| DGDxQ | CCCcC | 26.3 | 4.4 | 66.8 | 10.811019 | 2.3355e-14 | 1.00000 | B | 0.393713 | 0.065788 |
| QTPxR | HCHhH | 17.2 | 1.5 | 46.4 | 12.981638 | 3.4999e-14 | 1.00000 | B | 0.370690 | 0.032542 |
| ASGxT | HCCcC | 19.7 | 2.2 | 49.7 | 12.173113 | 3.6080e-14 | 1.00000 | B | 0.396378 | 0.043636 |
| TGKxF | CCHhH | 8.0 | 0.1 | 11.3 | 22.053631 | 6.4552e-14 | 1.00000 | B | 0.707965 | 0.011403 |
| NTKxD | CEEeE | 32.3 | 9.6 | 139.1 | 7.572258 | 6.5452e-14 | 1.00000 | N | 0.232207 | 0.069229 |
| KNVxC | EEEcC | 15.9 | 1.2 | 42.1 | 13.325318 | 8.2636e-14 | 1.00000 | B | 0.377672 | 0.029601 |
| SWGxG | EECcC | 20.9 | 2.4 | 146.2 | 11.989083 | 1.2563e-13 | 1.00000 | B | 0.142955 | 0.016530 |
| LGNxC | CCCcC | 8.0 | 0.1 | 14.5 | 22.390499 | 1.2699e-13 | 1.00000 | B | 0.551724 | 0.008606 |
| GNIxR | CCCcH | 5.0 | 0.0 | 10.7 | 52.390153 | 1.7043e-13 | 1.00000 | B | 0.467290 | 0.000849 |
| PGHxA | CCHhH | 11.3 | 0.5 | 18.8 | 15.376713 | 2.0088e-13 | 1.00000 | B | 0.601064 | 0.026934 |
| PPGxP | CCCcC | 24.9 | 4.1 | 88.4 | 10.603352 | 2.3088e-13 | 1.00000 | B | 0.281674 | 0.045833 |
| PTVVxI | CEEcC | 12.3 | 0.4 | 9.3 | 15.254719 | 2.7816e-13 | 1.00000 | B | 1.322581 | 0.038429 |
| AGVxR | CCChH | 7.8 | 0.1 | 21.6 | 26.565655 | 4.0849e-13 | 1.00000 | B | 0.361111 | 0.003920 |
| GYWxD | CCCeE | 6.6 | 0.1 | 6.1 | 26.353923 | 4.9686e-13 | 1.00000 | B | 1.081967 | 0.008706 |
| LGFxI | CCEeE | 9.2 | 0.2 | 34.0 | 19.338446 | 6.4511e-13 | 1.00000 | B | 0.270588 | 0.006387 |
| AAGxT | CCChH | 9.0 | 0.2 | 21.1 | 18.175548 | 7.2886e-13 | 1.00000 | B | 0.426540 | 0.011145 |
| VGKxT | CCHhH | 12.0 | 0.6 | 68.6 | 14.806952 | 9.9951e-13 | 1.00000 | B | 0.174927 | 0.008720 |
| GAGxT | CCChH | 13.6 | 0.9 | 51.8 | 13.538893 | 1.7051e-12 | 1.00000 | B | 0.262524 | 0.017297 |
| GSTxE | CEEeE | 15.9 | 1.8 | 28.0 | 10.991903 | 2.4901e-12 | 1.00000 | B | 0.567857 | 0.063033 |
| TFKxY | CCCeC | 9.5 | 0.5 | 9.5 | 12.661819 | 9.1849e-12 | 1.00000 | B | 1.000000 | 0.055941 |
| CLGxI | ECCcC | 6.0 | 0.1 | 10.0 | 23.464775 | 1.4656e-11 | 1.00000 | B | 0.600000 | 0.006440 |
| DAAxK | CCCcH | 9.0 | 0.3 | 22.0 | 15.053553 | 1.8970e-11 | 1.00000 | B | 0.409091 | 0.015289 |
| GSGxT | CCChH | 18.5 | 2.5 | 88.2 | 10.388049 | 2.1546e-11 | 1.00000 | B | 0.209751 | 0.027825 |
| LGIxI | CCEeE | 8.5 | 0.2 | 25.4 | 17.263867 | 2.6410e-11 | 1.00000 | B | 0.334646 | 0.009114 |
| QGSxK | CCCcH | 7.2 | 0.1 | 14.1 | 18.907162 | 2.7340e-11 | 1.00000 | B | 0.510638 | 0.009986 |
| IVNxT | ECCcC | 9.3 | 0.4 | 25.5 | 15.158694 | 2.7348e-11 | 1.00000 | B | 0.364706 | 0.013852 |
| FMRxL | CCCcC | 8.8 | 0.3 | 16.8 | 16.058362 | 2.8289e-11 | 1.00000 | B | 0.523810 | 0.017022 |
| DKPxY | CCCcC | 13.2 | 1.3 | 21.2 | 10.594109 | 3.0412e-11 | 1.00000 | B | 0.622642 | 0.063119 |
| CSAxV | CCCcC | 7.8 | 0.2 | 23.0 | 19.273690 | 3.4354e-11 | 1.00000 | B | 0.339130 | 0.006882 |
| QGKxS | CCHhH | 7.7 | 0.2 | 7.5 | 15.542889 | 3.4721e-11 | 1.00000 | B | 1.026667 | 0.030111 |
| FPExL | HHHhH | 17.3 | 2.3 | 71.5 | 10.172199 | 5.1552e-11 | 1.00000 | B | 0.241958 | 0.031580 |
| VSWxR | EEEcC | 4.3 | 0.0 | 5.3 | 43.831075 | 5.4189e-11 | 1.00000 | B | 0.811321 | 0.001811 |
| ETGxS | ECCcC | 17.6 | 2.4 | 62.0 | 10.000804 | 6.3892e-11 | 1.00000 | B | 0.283871 | 0.038748 |
| NGGxM | ECCcH | 8.1 | 0.3 | 11.2 | 14.070255 | 6.7783e-11 | 1.00000 | B | 0.723214 | 0.028125 |
| DMNxE | CCChH | 9.7 | 0.6 | 12.1 | 12.416785 | 7.4545e-11 | 1.00000 | B | 0.801653 | 0.046907 |
| NVGxS | CCChH | 10.0 | 0.6 | 26.6 | 12.303756 | 1.6309e-10 | 1.00000 | B | 0.375940 | 0.022460 |
| YTPxL | CCCcC | 11.1 | 0.8 | 39.8 | 11.762389 | 2.0298e-10 | 1.00000 | B | 0.278894 | 0.019713 |
| TGAxK | CCCcH | 8.1 | 0.3 | 16.4 | 14.066473 | 2.2656e-10 | 1.00000 | B | 0.493902 | 0.019052 |
| GTFxC | CCCcC | 7.0 | 0.3 | 8.3 | 13.618683 | 3.1057e-10 | 1.00000 | B | 0.843373 | 0.030500 |
| HALxV | EEEeE | 5.0 | 0.0 | 20.1 | 25.741017 | 3.3997e-10 | 1.00000 | B | 0.248756 | 0.001853 |
| AGIxR | CCChH | 5.9 | 0.1 | 21.2 | 24.217537 | 3.4816e-10 | 1.00000 | B | 0.278302 | 0.002752 |
| GAGxS | CCChH | 11.0 | 0.8 | 48.0 | 11.250818 | 5.2604e-10 | 1.00000 | B | 0.229167 | 0.017318 |
| ELCxL | ECCcC | 7.0 | 0.3 | 9.1 | 13.542555 | 5.3172e-10 | 1.00000 | B | 0.769231 | 0.028045 |
| DHGxT | CCChH | 7.0 | 0.2 | 29.3 | 15.970830 | 5.6202e-10 | 1.00000 | B | 0.238908 | 0.006257 |
| VGKxC | CCHhH | 10.0 | 0.6 | 60.7 | 12.076594 | 5.7001e-10 | 1.00000 | B | 0.164745 | 0.010060 |
| NQTxN | HHChH | 17.4 | 2.9 | 46.3 | 8.876820 | 6.1701e-10 | 1.00000 | B | 0.375810 | 0.061769 |
| GGTxK | CCCcH | 8.0 | 0.3 | 32.5 | 13.907304 | 6.5278e-10 | 1.00000 | B | 0.246154 | 0.009501 |
| GLGxS | ECCeE | 5.5 | 0.1 | 6.7 | 20.909266 | 8.0589e-10 | 1.00000 | B | 0.820896 | 0.010176 |
| WGRxV | HHHhH | 7.3 | 0.2 | 26.2 | 15.359753 | 1.0620e-09 | 1.00000 | B | 0.278626 | 0.008189 |
| AGIxR | CCCcH | 7.5 | 0.2 | 24.2 | 14.824604 | 1.6308e-09 | 1.00000 | B | 0.309917 | 0.010005 |
| QCGxC | CCCcH | 7.1 | 0.2 | 20.2 | 14.323869 | 1.7811e-09 | 1.00000 | B | 0.351485 | 0.011512 |
| SSTxN | CCChH | 7.0 | 0.3 | 9.0 | 12.195858 | 2.0164e-09 | 1.00000 | B | 0.777778 | 0.034617 |
| MELxT | EECcC | 10.0 | 0.8 | 29.5 | 10.706236 | 2.0986e-09 | 1.00000 | B | 0.338983 | 0.025898 |
| QGIxS | CCHhH | 7.0 | 0.3 | 11.2 | 12.503979 | 3.1879e-09 | 1.00000 | B | 0.625000 | 0.026366 |
| HGKxT | CCHhH | 7.0 | 0.2 | 38.9 | 14.055817 | 3.5464e-09 | 1.00000 | B | 0.179949 | 0.005994 |
| ATNxR | CCChH | 9.3 | 0.4 | 7.4 | 10.764547 | 4.1930e-09 | 1.00000 | B | 1.256757 | 0.060028 |
| GQGxG | CCChH | 8.0 | 0.5 | 14.1 | 11.032259 | 4.9378e-09 | 1.00000 | B | 0.567376 | 0.034108 |
| RIVxY | EECcC | 10.8 | 1.0 | 25.1 | 9.968876 | 5.1361e-09 | 1.00000 | B | 0.430279 | 0.040063 |
| RGLxR | CCHhH | 7.0 | 0.3 | 10.7 | 11.925372 | 5.1481e-09 | 1.00000 | B | 0.654206 | 0.030208 |

TABLE 19

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| AGKTT | CCHHH | 30.3 | 0.2 | 53.3 | 60.465312 | 5.5259e−56 | 1.00000 | B | 0.568480 | 0.004656 |
| TKVDK | EEEEE | 86.3 | 20.3 | 363.4 | 15.071953 | 6.9306e−51 | 1.00000 | N | 0.237479 | 0.055879 |
| STKVD | CEEEE | 61.6 | 13.0 | 230.1 | 13.904790 | 2.1619e−43 | 1.00000 | N | 0.267710 | 0.056344 |
| GVGKS | CCCHH | 34.9 | 1.2 | 109.6 | 31.386429 | 1.1635e−40 | 1.00000 | B | 0.318431 | 0.010653 |
| KVDKK | EEEEE | 71.2 | 19.4 | 341.6 | 12.131059 | 1.4989e−33 | 1.00000 | N | 0.208431 | 0.056672 |
| CSAGI | CCCCC | 10.8 | 0.0 | 21.7 | 119.020953 | 6.6042e−30 | 1.00000 | B | 0.497696 | 0.000379 |
| SGKST | CCHHH | 19.2 | 0.4 | 74.8 | 29.140926 | 2.5218e−26 | 1.00000 | B | 0.256684 | 0.005585 |
| GFTNS | CCHHH | 24.7 | 1.3 | 41.2 | 20.894474 | 2.9243e−26 | 1.00000 | B | 0.599515 | 0.031442 |
| VGKSS | CCHHH | 15.0 | 0.2 | 36.0 | 36.980645 | 3.1208e−26 | 1.00000 | B | 0.416667 | 0.004492 |
| SGKTT | CCHHH | 19.7 | 0.5 | 60.8 | 27.874101 | 6.8319e−26 | 1.00000 | B | 0.324013 | 0.007883 |
| GSGKS | CCCHH | 19.6 | 0.6 | 66.7 | 25.190609 | 3.6713e−24 | 1.00000 | B | 0.293853 | 0.008626 |
| SGVGK | CCCCH | 18.3 | 0.5 | 53.4 | 25.703105 | 6.9392e−24 | 1.00000 | B | 0.342697 | 0.009079 |
| NVACK | EECCC | 24.2 | 1.6 | 45.0 | 18.282352 | 1.9905e−23 | 1.00000 | B | 0.537778 | 0.035242 |
| VGKTS | CCHHH | 15.5 | 0.3 | 39.7 | 29.802692 | 3.1710e−23 | 1.00000 | B | 0.390428 | 0.006628 |
| DNAGK | CCCCH | 9.3 | 0.0 | 13.0 | 51.914426 | 1.6236e−21 | 1.00000 | B | 0.715385 | 0.002458 |
| NAGKT | CCCHH | 9.3 | 0.0 | 13.9 | 52.186777 | 2.0505e−21 | 1.00000 | B | 0.669065 | 0.002274 |
| GTGKT | CCCHH | 22.0 | 1.3 | 99.0 | 18.387859 | 6.8722e−21 | 1.00000 | B | 0.222222 | 0.012987 |
| SSTKV | HCEEE | 41.4 | 11.0 | 198.1 | 9.427547 | 9.0951e−21 | 1.00000 | N | 0.208985 | 0.055556 |
| QTGKT | CCCHH | 15.3 | 0.6 | 18.2 | 20.141893 | 1.2540e−20 | 1.00000 | B | 0.840659 | 0.030377 |
| TQTGK | CCCCH | 15.3 | 0.6 | 14.3 | 18.234366 | 7.0811e−20 | 1.00000 | B | 1.069930 | 0.041235 |
| AGIGR | CCCCH | 7.5 | 0.0 | 16.7 | 77.399169 | 1.4536e−19 | 1.00000 | B | 0.449102 | 0.000561 |
| VACKN | ECCCC | 20.9 | 1.5 | 43.0 | 16.412549 | 2.2938e−19 | 1.00000 | B | 0.486047 | 0.033792 |
| ACKNG | CCCCC | 21.6 | 1.7 | 43.0 | 15.804325 | 3.8946e−19 | 1.00000 | B | 0.502326 | 0.038517 |
| NTKVD | CEEEE | 32.3 | 7.8 | 136.3 | 9.001505 | 5.8508e−19 | 1.00000 | N | 0.236977 | 0.057495 |
| VGKSA | CCHHH | 12.4 | 0.2 | 44.0 | 27.218777 | 9.6246e−19 | 1.00000 | B | 0.281818 | 0.004586 |
| TGTGK | CCCCH | 13.2 | 0.3 | 23.9 | 22.531929 | 1.1028e−18 | 1.00000 | B | 0.552301 | 0.013841 |
| CSAGV | CCCCC | 6.8 | 0.0 | 21.0 | 90.676937 | 3.9652e−18 | 1.00000 | B | 0.323810 | 0.000267 |
| GLTDW | EECCC | 9.1 | 0.1 | 9.4 | 28.126064 | 5.9368e−18 | 1.00000 | B | 0.968085 | 0.011006 |
| YASGR | HHCCC | 17.3 | 1.1 | 30.0 | 16.136826 | 9.8425e−18 | 1.00000 | B | 0.576667 | 0.035026 |
| TDVVG | CCHHH | 2.0 | 0.0 | 2.0 | 9.169227 | 1.0079e−17 | 1.00000 | B | 1.000000 | 0.023236 |
| GTDVV | CCCHH | 4.0 | 0.1 | 2.0 | 6.652325 | 1.8372e−17 | 1.00000 | B | 2.000000 | 0.043240 |
| ASGRT | HCCCC | 17.7 | 1.1 | 31.9 | 15.804729 | 2.5121e−17 | 1.00000 | B | 0.554859 | 0.035695 |
| AAGKT | CCCHH | 9.0 | 0.1 | 19.0 | 32.243836 | 2.5944e−17 | 1.00000 | B | 0.473684 | 0.004047 |
| GAGKT | CCCHH | 13.6 | 0.4 | 44.3 | 21.167039 | 3.8339e−17 | 1.00000 | B | 0.306998 | 0.008867 |
| QSTYS | CCCEE | 1.3 | 0.1 | 1.0 | 4.271212 | 1.0525e−16 | 1.00000 | B | 1.300000 | 0.051966 |
| IASVA | EEECC | 3.0 | 0.1 | 1.0 | 4.319109 | 1.0537e−16 | 1.00000 | B | 3.000000 | 0.050878 |
| HTFID | ECCCC | 1.0 | 0.0 | 1.0 | 4.414173 | 1.0560e−16 | 1.00000 | B | 1.000000 | 0.048816 |
| HIASV | EEEEC | 3.0 | 0.0 | 1.0 | 4.435998 | 1.0565e−16 | 1.00000 | B | 3.000000 | 0.048360 |
| SRTGT | CCCCC | 1.0 | 0.0 | 1.0 | 4.483287 | 1.0576e−16 | 1.00000 | B | 1.000000 | 0.047394 |
| PSLPT | CCCCC | 1.0 | 0.0 | 1.0 | 4.729112 | 1.0627e−16 | 1.00000 | B | 1.000000 | 0.042800 |
| FADKL | EEECC | 1.5 | 0.0 | 1.0 | 4.930669 | 1.0664e−16 | 1.00000 | B | 1.500000 | 0.039508 |
| HESEN | EECCC | 1.0 | 0.0 | 1.0 | 4.970215 | 1.0670e−16 | 1.00000 | B | 1.000000 | 0.038906 |
| GTMKP | CCCCC | 1.7 | 0.0 | 1.0 | 5.689319 | 1.0770e−16 | 1.00000 | B | 1.700000 | 0.029969 |
| TQQHG | ECCCC | 2.0 | 0.0 | 1.0 | 6.095078 | 1.0811e−16 | 1.00000 | B | 2.000000 | 0.026212 |
| YIKIH | EECCC | 1.5 | 0.0 | 1.0 | 6.298304 | 1.0829e−16 | 1.00000 | B | 1.500000 | 0.024589 |
| ITTLD | EEEEE | 1.0 | 0.0 | 1.0 | 6.443160 | 1.0841e−16 | 1.00000 | B | 1.000000 | 0.023521 |
| NALAS | CCCCC | 1.0 | 0.0 | 1.0 | 7.078294 | 1.0885e−16 | 1.00000 | B | 1.000000 | 0.019569 |
| RGFSG | CCECC | 1.0 | 0.0 | 1.0 | 7.563653 | 1.0911e−16 | 1.00000 | B | 1.000000 | 0.017180 |
| SLFLE | CCHHH | 1.0 | 0.0 | 1.0 | 8.389016 | 1.0947e−16 | 1.00000 | B | 1.000000 | 0.014010 |
| GYRDN | CCEEE | 1.0 | 0.0 | 1.0 | 12.986148 | 1.1037e−16 | 1.00000 | B | 1.000000 | 0.005895 |
| QFNTN | CECCC | 16.8 | 1.1 | 28.1 | 15.369429 | 1.1857e−16 | 1.00000 | B | 0.597865 | 0.038692 |
| DAAGK | CCCCH | 9.0 | 0.1 | 20.1 | 29.526979 | 1.4194e−16 | 1.00000 | B | 0.447761 | 0.004549 |
| LGNIC | CCCCC | 6.0 | 0.0 | 9.0 | 57.956075 | 2.3546e−16 | 1.00000 | B | 0.666667 | 0.001188 |
| CLGNI | ECCCC | 6.0 | 0.0 | 9.0 | 55.536718 | 3.9218e−16 | 1.00000 | B | 0.666667 | 0.001294 |
| PPGPP | CCCCC | 16.8 | 1.2 | 31.0 | 14.517116 | 1.0146e−15 | 1.00000 | B | 0.541935 | 0.038746 |
| GNICR | CCCCH | 5.0 | 0.0 | 10.7 | 86.957797 | 1.0862e−15 | 1.00000 | B | 0.467290 | 0.000309 |
| QDKEG | HHHHC | 23.5 | 3.0 | 53.3 | 12.128908 | 1.5706e−15 | 1.00000 | B | 0.440901 | 0.056696 |
| AGVGR | CCCHH | 7.3 | 0.0 | 20.1 | 39.450567 | 2.1921e−15 | 1.00000 | B | 0.363184 | 0.001691 |
| HALAV | EEEEE | 5.0 | 0.0 | 7.7 | 68.668141 | 6.5384e−15 | 1.00000 | B | 0.649351 | 0.000688 |
| NVGKS | CCHHH | 10.0 | 0.2 | 23.0 | 20.863516 | 7.0957e−15 | 1.00000 | B | 0.434783 | 0.009643 |
| SAGIG | CCCCH | 5.9 | 0.0 | 20.5 | 70.678886 | 8.0219e−15 | 1.00000 | B | 0.287805 | 0.000339 |
| TGKTF | CCHHH | 8.0 | 0.1 | 9.8 | 23.661871 | 9.8853e−15 | 1.00000 | B | 0.816327 | 0.011470 |
| GSGKT | CCHHH | 16.5 | 1.1 | 77.1 | 14.568931 | 1.4235e−14 | 1.00000 | B | 0.214008 | 0.014651 |
| QTPNR | HCHHH | 17.2 | 1.5 | 46.4 | 13.229385 | 2.0671e−14 | 1.00000 | B | 0.370690 | 0.031495 |
| SAGVG | CCCCH | 7.5 | 0.0 | 20.4 | 33.668542 | 2.0857e−14 | 1.00000 | B | 0.367647 | 0.002407 |
| GSTVE | CEEEE | 15.9 | 1.4 | 24.4 | 12.865137 | 2.1829e−14 | 1.00000 | B | 0.651639 | 0.055473 |
| AGIGR | CCCHH | 5.9 | 0.0 | 20.2 | 61.060994 | 3.4266e−14 | 1.00000 | B | 0.292079 | 0.000461 |
| MELCT | EECCC | 8.0 | 0.1 | 11.1 | 21.886741 | 6.6835e−14 | 1.00000 | B | 0.720721 | 0.011785 |
| KNVAC | EEECC | 15.9 | 1.2 | 42.1 | 13.367493 | 7.6225e−14 | 1.00000 | B | 0.377672 | 0.029438 |
| ACNGD | CCCCC | 5.0 | 0.0 | 6.0 | 48.691508 | 9.9218e−14 | 1.00000 | B | 0.833333 | 0.001753 |
| RGLGR | CCHHH | 7.0 | 0.1 | 7.0 | 21.735542 | 1.4144e−13 | 1.00000 | B | 1.000000 | 0.014601 |
| TWNIG | EECCC | 12.3 | 0.3 | 9.3 | 15.690258 | 1.7089e−13 | 1.00000 | B | 1.322581 | 0.036401 |
| PTWNI | CEECC | 12.3 | 0.3 | 9.3 | 15.586625 | 1.9168e−13 | 1.00000 | B | 1.322581 | 0.036869 |
| GGTGK | CCCCH | 8.0 | 0.1 | 32.0 | 22.161607 | 5.8435e−13 | 1.00000 | B | 0.250000 | 0.003960 |
| VGKSN | CCHHH | 6.3 | 0.0 | 11.0 | 31.650387 | 6.5990e−13 | 1.00000 | B | 0.572727 | 0.003570 |
| GAGKS | CCCHH | 9.0 | 0.2 | 22.4 | 18.251205 | 7.6963e−13 | 1.00000 | B | 0.401786 | 0.010409 |
| TGAGK | CCCCH | 8.1 | 0.2 | 15.0 | 19.304260 | 1.5160e−12 | 1.00000 | B | 0.540000 | 0.011377 |

TABLE 19-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| QGIMS | CCHHH | 5.0 | 0.0 | 5.0 | 33.817618 | 1.5630e-12 | 1.00000 | B | 1.000000 | 0.004353 |
| DHGKT | CCCHH | 7.0 | 0.1 | 29.2 | 24.300680 | 2.0219e-12 | 1.00000 | B | 0.239726 | 0.002784 |
| IVNYT | ECCCC | 9.3 | 0.3 | 22.0 | 17.173156 | 2.6007e-12 | 1.00000 | B | 0.422727 | 0.012703 |
| TGKTT | CCHHH | 10.0 | 0.4 | 49.2 | 15.782827 | 4.3075e-12 | 1.00000 | B | 0.203252 | 0.007617 |
| FMRIL | CCCCC | 8.8 | 0.2 | 15.0 | 17.816749 | 4.4112e-12 | 1.00000 | B | 0.586667 | 0.015652 |
| VGKST | CCHHH | 9.7 | 0.3 | 41.3 | 17.282948 | 5.1363e-12 | 1.00000 | B | 0.234867 | 0.007218 |
| PNVGK | CCCCH | 8.5 | 0.2 | 24.0 | 17.650727 | 1.7561e-11 | 1.00000 | B | 0.354167 | 0.009250 |
| TFKFY | CCCEC | 8.0 | 0.3 | 9.5 | 14.144154 | 2.3311e-11 | 1.00000 | B | 0.842105 | 0.032186 |
| SAGIG | CCCCC | 7.8 | 0.2 | 18.3 | 19.277002 | 2.5815e-11 | 1.00000 | B | 0.426230 | 0.008662 |
| SPSSL | ECCEE | 22.6 | 6.2 | 113.2 | 6.737919 | 3.2449e-11 | 1.00000 | N | 0.199647 | 0.055120 |
| AGKST | CCHHH | 8.6 | 0.3 | 24.6 | 16.358492 | 5.5030e-11 | 1.00000 | B | 0.349593 | 0.010673 |
| NQTPN | HHCHH | 17.4 | 2.5 | 46.3 | 9.807330 | 5.7989e-11 | 1.00000 | B | 0.375810 | 0.052976 |
| AGKTS | CCHHH | 4.6 | 0.0 | 6.5 | 45.221979 | 5.9445e-11 | 1.00000 | B | 0.707692 | 0.001587 |
| QGSGK | CCCCH | 7.2 | 0.2 | 12.9 | 17.266587 | 7.6089e-11 | 1.00000 | B | 0.558140 | 0.013027 |
| STGNT | CCCCC | 8.0 | 0.3 | 11.6 | 13.943602 | 8.2471e-11 | 1.00000 | B | 0.689655 | 0.026930 |
| HGKTT | CCHHH | 7.0 | 0.1 | 35.2 | 18.613204 | 8.4185e-11 | 1.00000 | B | 0.198864 | 0.003878 |
| SGSGK | CCCCH | 6.7 | 0.1 | 22.8 | 22.484912 | 8.4213e-11 | 1.00000 | B | 0.293860 | 0.003809 |
| GQGIM | CCCHH | 5.0 | 0.0 | 5.0 | 22.627078 | 8.4618e-11 | 1.00000 | B | 1.000000 | 0.009671 |
| YSTMS | CCCEE | 11.7 | 0.8 | 42.8 | 12.014476 | 1.5892e-10 | 1.00000 | B | 0.273364 | 0.019490 |
| QTGTG | CCCCC | 7.5 | 0.2 | 10.0 | 15.134947 | 2.3135e-10 | 1.00000 | B | 0.750000 | 0.023592 |
| VSWGR | EEECC | 4.3 | 0.0 | 5.3 | 36.339637 | 2.4138e-10 | 1.00000 | B | 0.811321 | 0.002632 |
| FTVAQ | CCHHH | 7.1 | 0.2 | 15.0 | 16.089718 | 2.4804e-10 | 1.00000 | B | 0.473333 | 0.012462 |

TABLE 20

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| LxxxxR | CchhhH | 243.0 | 57.8 | 1351.9 | 24.885394 | 2.8521e-136 | 1.00000 | N | 0.179747 | 0.042782 |
| GxxxxQ | CcchhH | 255.1 | 81.2 | 1223.1 | 19.980536 | 1.2830e-88 | 1.00000 | N | 0.208568 | 0.066361 |
| LxxxxQ | CchhhH | 126.4 | 29.8 | 922.6 | 18.007172 | 4.5848e-72 | 1.00000 | N | 0.137004 | 0.032258 |
| LxxxxK | CchhhH | 149.3 | 41.7 | 947.4 | 17.047502 | 7.0481e-65 | 1.00000 | N | 0.157589 | 0.043999 |
| GxxxxE | CcchhH | 400.5 | 186.8 | 2725.7 | 16.199779 | 4.6835e-59 | 1.00000 | N | 0.146935 | 0.068536 |
| LxxxxM | CchhhH | 61.6 | 11.4 | 519.7 | 15.057313 | 1.4748e-50 | 1.00000 | N | 0.118530 | 0.021888 |
| GxxxxT | CcchhH | 210.7 | 80.5 | 1540.2 | 14.898100 | 3.9858e-50 | 1.00000 | N | 0.136800 | 0.052292 |
| LxxxxI | CchhhH | 120.9 | 37.9 | 1893.6 | 13.610400 | 5.3167e-42 | 1.00000 | N | 0.063864 | 0.020034 |
| AxxxxV | HhhhcC | 87.4 | 23.0 | 1099.8 | 13.589463 | 9.7121e-42 | 1.00000 | N | 0.079469 | 0.020879 |
| ExxxxW | CcchhH | 36.1 | 5.3 | 134.0 | 13.677958 | 1.4188e-41 | 1.00000 | N | 0.269403 | 0.039434 |
| IxxxxR | CchhhH | 79.2 | 20.1 | 469.1 | 13.463888 | 5.9268e-41 | 1.00000 | N | 0.168834 | 0.042888 |
| SxxxxR | CchhhH | 124.8 | 41.7 | 647.7 | 13.306610 | 3.0825e-40 | 1.00000 | N | 0.192662 | 0.064369 |
| AxxxxR | CchhhH | 115.3 | 37.0 | 706.6 | 13.228266 | 9.2344e-40 | 1.00000 | N | 0.163176 | 0.052343 |
| AxxxxI | HhhhcC | 71.2 | 17.1 | 836.7 | 13.234870 | 1.3942e-39 | 1.00000 | N | 0.085096 | 0.020406 |
| ExxxxR | EecceE | 59.1 | 13.4 | 159.8 | 13.057590 | 1.8573e-38 | 1.00000 | N | 0.369837 | 0.083731 |
| RxxxxE | HhhccC | 173.9 | 70.9 | 874.0 | 12.761204 | 2.9847e-37 | 1.00000 | N | 0.198970 | 0.081120 |
| SxxxxQ | CchhhH | 107.1 | 34.6 | 557.3 | 12.734676 | 5.8204e-37 | 1.00000 | N | 0.192177 | 0.062044 |
| NxxxxE | CcchhH | 188.1 | 80.7 | 1090.7 | 12.430866 | 1.8292e-35 | 1.00000 | N | 0.172458 | 0.073955 |
| GxxxxS | CcchhH | 154.1 | 60.6 | 1208.3 | 12.329694 | 7.0867e-35 | 1.00000 | N | 0.127535 | 0.050132 |
| LxxxxL | CchhhH | 154.3 | 60.1 | 2989.1 | 12.264411 | 1.5679e-34 | 1.00000 | N | 0.051621 | 0.020122 |
| TxxxxR | CchhhH | 97.2 | 31.2 | 509.4 | 12.189503 | 5.4680e-34 | 1.00000 | N | 0.190813 | 0.061279 |
| SxxxxR | ChhhhH | 261.0 | 129.5 | 1853.7 | 11.982428 | 3.8015e-33 | 1.00000 | N | 0.140799 | 0.069857 |
| FxxxxR | CchhhH | 53.8 | 12.6 | 341.3 | 11.807882 | 9.6778e-32 | 1.00000 | N | 0.157633 | 0.036994 |
| SxxxxE | CcchhH | 192.1 | 88.4 | 1305.4 | 11.424853 | 2.9571e-30 | 1.00000 | N | 0.147158 | 0.067710 |
| VxxxxF | CchhhH | 39.3 | 7.9 | 319.7 | 11.295066 | 5.2957e-29 | 1.00000 | N | 0.122928 | 0.024762 |
| FxxxxE | EcchhH | 34.0 | 6.3 | 182.6 | 11.217448 | 1.6197e-28 | 1.00000 | N | 0.186199 | 0.034562 |
| GxxxxD | CcchhH | 262.4 | 137.5 | 2156.0 | 11.007428 | 2.8665e-28 | 1.00000 | N | 0.121707 | 0.063779 |
| TxxxxT | EecceE | 82.4 | 27.3 | 361.9 | 10.952964 | 9.5962e-28 | 1.00000 | N | 0.227687 | 0.075539 |
| TxxxxR | CchhhH | 153.7 | 67.3 | 1094.5 | 10.868932 | 1.6117e-27 | 1.00000 | N | 0.140429 | 0.061501 |
| KxxxxW | EecceE | 36.7 | 7.5 | 127.6 | 10.966382 | 2.1756e-27 | 1.00000 | N | 0.287618 | 0.058953 |
| DxxxxR | CchhhH | 136.7 | 58.0 | 811.5 | 10.718357 | 8.6960e-27 | 1.00000 | N | 0.168453 | 0.071505 |
| YxxxxE | CcchhH | 85.7 | 29.3 | 538.1 | 10.711761 | 1.2450e-26 | 1.00000 | N | 0.159264 | 0.054469 |
| LxxxxI | HhhccC | 81.5 | 26.8 | 1641.0 | 10.661638 | 2.1892e-26 | 1.00000 | N | 0.049665 | 0.016319 |
| RxxxxF | EeeccC | 48.1 | 12.1 | 197.8 | 10.669917 | 3.4327e-26 | 1.00000 | N | 0.243175 | 0.061253 |
| KxxxxY | EecceE | 31.7 | 6.0 | 126.7 | 10.691459 | 5.1661e-26 | 1.00000 | N | 0.250197 | 0.047719 |
| GxxxxR | CchhhH | 118.7 | 48.8 | 850.2 | 10.297931 | 7.7223e-25 | 1.00000 | N | 0.139614 | 0.057438 |
| GxxxxR | CcchhH | 133.1 | 57.9 | 856.2 | 10.244740 | 1.2603e-24 | 1.00000 | N | 0.155454 | 0.067572 |
| ExxxxE | CcchhH | 191.6 | 95.5 | 1299.3 | 10.213154 | 1.4953e-24 | 1.00000 | N | 0.147464 | 0.073517 |
| GxxxxN | CcchhH | 104.6 | 41.2 | 673.7 | 10.207393 | 2.0976e-24 | 1.00000 | N | 0.155262 | 0.061083 |
| QxxxxT | EecceE | 35.6 | 7.8 | 134.6 | 10.298441 | 2.4065e-24 | 1.00000 | N | 0.264487 | 0.057628 |
| VxxxxQ | EchhCc | 23.8 | 1.4 | 40.9 | 19.211871 | 4.9634e-24 | 1.00000 | B | 0.581992 | 0.034401 |
| RxxxxD | HhhccC | 174.6 | 85.9 | 1073.6 | 9.970399 | 1.8063e-23 | 1.00000 | N | 0.162646 | 0.080061 |
| FxxxxE | CcchhH | 87.8 | 32.5 | 685.4 | 9.926259 | 3.9216e-23 | 1.00000 | N | 0.128100 | 0.047474 |
| LxxxxV | CchhhH | 90.3 | 33.8 | 1719.7 | 9.813784 | 1.1574e-22 | 1.00000 | N | 0.052509 | 0.019657 |
| RxxxxH | HhhccC | 65.2 | 21.7 | 297.8 | 9.703437 | 4.3224e-22 | 1.00000 | N | 0.218939 | 0.072826 |
| GxxxxY | CcchhH | 68.3 | 23.1 | 533.9 | 9.630341 | 8.3399e-22 | 1.00000 | N | 0.127927 | 0.043196 |

TABLE 20-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| AxxxxE | CcchhH | 148.0 | 70.1 | 1242.5 | 9.573740 | 9.3271e-22 | 1.00000 | N | 0.119115 | 0.056438 |
| WxxxxR | CchhhH | 33.4 | 7.5 | 151.7 | 9.659593 | 1.3620e-21 | 1.00000 | N | 0.220171 | 0.049712 |
| DxxxxT | EccccE | 70.6 | 24.4 | 581.0 | 9.569481 | 1.4539e-21 | 1.00000 | N | 0.121515 | 0.041937 |
| PxxxxQ | CcchhH | 109.4 | 46.5 | 1083.7 | 9.421620 | 4.5216e-21 | 1.00000 | N | 0.100950 | 0.042935 |
| DxxxxR | ChhhhH | 237.0 | 133.2 | 1783.9 | 9.344319 | 7.0694e-21 | 1.00000 | N | 0.132885 | 0.074710 |
| GxxxxK | CcchhH | 153.6 | 75.4 | 1023.0 | 9.348950 | 7.7771e-21 | 1.00000 | N | 0.150147 | 0.073750 |
| TxxxxR | ChhhhH | 192.4 | 101.8 | 1444.8 | 9.314664 | 9.9140e-21 | 1.00000 | N | 0.133167 | 0.070455 |
| RxxxxQ | CcchhH | 80.6 | 30.6 | 502.4 | 9.316053 | 1.4468e-20 | 1.00000 | N | 0.160430 | 0.060976 |
| YxxxxG | EcccC | 128.5 | 59.1 | 1454.7 | 9.226183 | 2.6007e-20 | 1.00000 | N | 0.088334 | 0.040595 |
| QxxxxE | CchhhH | 111.8 | 49.3 | 708.3 | 9.233590 | 2.6009e-20 | 1.00000 | N | 0.157843 | 0.069571 |
| DxxxxE | CcchhH | 154.5 | 77.4 | 1117.3 | 9.079327 | 9.3679e-20 | 1.00000 | N | 0.138280 | 0.069298 |
| FxxxxY | CchhhC | 30.2 | 6.8 | 172.7 | 9.178860 | 1.3184e-19 | 1.00000 | N | 0.174870 | 0.039245 |
| ExxxxS | HhhccC | 134.5 | 64.7 | 919.1 | 8.999618 | 2.0332e-19 | 1.00000 | N | 0.146339 | 0.070398 |
| NxxxxR | CchhhH | 74.6 | 28.5 | 442.8 | 8.941105 | 4.6087e-19 | 1.00000 | N | 0.168473 | 0.064272 |
| QxxxxL | EecceE | 42.9 | 12.1 | 459.9 | 8.967760 | 5.6147e-19 | 1.00000 | N | 0.093281 | 0.026328 |
| ExxxxV | EcceeE | 46.8 | 14.0 | 318.4 | 8.939876 | 6.6359e-19 | 1.00000 | N | 0.146985 | 0.044109 |
| VxxxxR | EchhhC | 25.4 | 2.5 | 69.9 | 14.588668 | 8.5240e-19 | 1.00000 | B | 0.363376 | 0.036434 |
| ExxxxK | HchhhC | 29.4 | 6.9 | 82.3 | 8.942929 | 1.1236e-18 | 1.00000 | N | 0.357203 | 0.083914 |
| DxxxxQ | ChhhhH | 152.3 | 77.8 | 1117.8 | 8.751110 | 1.7751e-18 | 1.00000 | N | 0.136250 | 0.069630 |
| KxxxxY | HhhccC | 67.0 | 24.7 | 384.0 | 8.786447 | 1.9357e-18 | 1.00000 | N | 0.174479 | 0.064410 |
| ExxxxL | EecceE | 40.3 | 11.3 | 277.3 | 8.826998 | 2.0686e-18 | 1.00000 | N | 0.145330 | 0.040651 |
| CxxxxY | EecccC | 27.4 | 3.0 | 127.4 | 14.220807 | 2.5238e-18 | 1.00000 | B | 0.215071 | 0.023644 |
| PxxxxR | CchhhH | 112.2 | 51.7 | 866.2 | 8.685640 | 3.5307e-18 | 1.00000 | N | 0.129531 | 0.059641 |
| GxxxxQ | CchhhH | 65.4 | 23.9 | 462.5 | 8.714553 | 3.6676e-18 | 1.00000 | N | 0.141405 | 0.051690 |
| GxxxxQ | CcehhH | 28.4 | 6.7 | 87.1 | 8.747114 | 6.3844e-18 | 1.00000 | N | 0.326062 | 0.076678 |
| NxxxxK | CchhhH | 81.3 | 33.5 | 456.0 | 8.591494 | 9.3418e-18 | 1.00000 | N | 0.178269 | 0.073378 |
| YxxxxH | CcccE | 25.8 | 5.6 | 128.0 | 8.709907 | 9.9702e-18 | 1.00000 | N | 0.201563 | 0.043878 |
| ExxxxK | EcceeE | 43.1 | 13.1 | 168.8 | 8.606301 | 1.3067e-17 | 1.00000 | N | 0.255332 | 0.077849 |
| LxxxxE | CcchhH | 116.0 | 54.7 | 1020.9 | 8.516601 | 1.4929e-17 | 1.00000 | N | 0.113625 | 0.053595 |
| ExxxxR | CchhhH | 96.4 | 42.8 | 631.6 | 8.492481 | 1.9932e-17 | 1.00000 | N | 0.152628 | 0.067721 |
| ExxxxR | EcceeE | 39.2 | 11.5 | 139.1 | 8.542044 | 2.4730e-17 | 1.00000 | N | 0.281812 | 0.082523 |
| IxxxxL | CchhhH | 79.6 | 32.1 | 1654.6 | 8.474998 | 2.5182e-17 | 1.00000 | N | 0.048108 | 0.019383 |
| SxxxxQ | CcchhH | 97.8 | 43.8 | 663.1 | 8.432856 | 3.2796e-17 | 1.00000 | N | 0.147489 | 0.066115 |
| KxxxxN | HhhccC | 132.1 | 66.5 | 806.8 | 8.389233 | 4.2077e-17 | 1.00000 | N | 0.163733 | 0.082483 |
| ExxxxR | HhhccC | 116.1 | 55.9 | 742.2 | 8.375368 | 4.9567e-17 | 1.00000 | N | 0.156427 | 0.075303 |
| HxxxxR | CchhhH | 42.2 | 12.9 | 198.2 | 8.441254 | 5.3279e-17 | 1.00000 | N | 0.212916 | 0.065049 |
| MxxxxR | CchhhH | 51.3 | 17.3 | 353.0 | 8.401305 | 6.2683e-17 | 1.00000 | N | 0.145326 | 0.048896 |
| WxxxxK | HhhhcC | 38.8 | 11.2 | 266.7 | 8.429782 | 6.3105e-17 | 1.00000 | N | 0.145482 | 0.041973 |
| GxxxxF | EecceE | 33.3 | 8.7 | 334.0 | 8.436510 | 6.9899e-17 | 1.00000 | N | 0.099674 | 0.026101 |
| VxxxxR | CchhhH | 75.7 | 30.6 | 650.5 | 8.356763 | 7.0348e-17 | 1.00000 | N | 0.116372 | 0.047016 |
| VxxxxF | CchhhH | 40.9 | 12.1 | 688.2 | 8.383240 | 8.7602e-17 | 1.00000 | N | 0.059430 | 0.017513 |
| RxxxxR | HhhhhH | 509.6 | 359.0 | 4907.4 | 8.254956 | 9.5544e-17 | 1.00000 | N | 0.103843 | 0.073158 |
| SxxxxQ | ChhhhH | 176.9 | 97.8 | 1537.4 | 8.267115 | 1.0620e-16 | 1.00000 | N | 0.115064 | 0.063607 |
| VxxxxE | EcchhH | 59.9 | 21.9 | 499.1 | 8.298175 | 1.3176e-16 | 1.00000 | N | 0.120016 | 0.043910 |
| GxxxxA | CcchhH | 152.0 | 80.0 | 1799.4 | 8.235044 | 1.4447e-16 | 1.00000 | N | 0.084473 | 0.044459 |
| RxxxxE | EecceE | 36.6 | 10.6 | 131.4 | 8.302230 | 1.9387e-16 | 1.00000 | N | 0.278539 | 0.080969 |
| IxxxxY | EcceeE | 25.5 | 5.7 | 229.8 | 8.350186 | 1.9949e-16 | 1.00000 | N | 0.110966 | 0.024988 |
| YxxxxQ | EccccC | 41.7 | 12.9 | 277.2 | 8.238435 | 2.8485e-16 | 1.00000 | N | 0.150433 | 0.046375 |
| KxxxxE | EcceeE | 180.8 | 102.1 | 1300.8 | 8.119417 | 3.5770e-16 | 1.00000 | N | 0.138991 | 0.078458 |
| RxxxxL | HhhccC | 95.2 | 43.3 | 774.6 | 8.128103 | 4.1443e-16 | 1.00000 | N | 0.122902 | 0.055843 |
| ExxxxY | EcceeE | 29.7 | 7.7 | 170.1 | 8.125602 | 1.0025e-15 | 1.00000 | N | 0.174603 | 0.045189 |
| ExxxxD | HhhheC | 18.8 | 1.6 | 44.9 | 13.980628 | 1.0075e-15 | 1.00000 | B | 0.418708 | 0.035042 |
| QxxxxQ | CchhhH | 45.1 | 15.0 | 238.9 | 8.045709 | 1.2643e-15 | 1.00000 | N | 0.188782 | 0.062644 |

TABLE 21

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| VxxxNF | CcchHH | 23.5 | 0.1 | 36.1 | 60.676785 | 1.6831e-46 | 1.00000 | B | 0.650970 | 0.004120 |
| TxxxKT | CcccHH | 42.4 | 3.9 | 131.3 | 19.889388 | 9.5748e-32 | 1.00000 | B | 0.322925 | 0.029453 |
| AxxxGV | HhhhCC | 45.2 | 9.8 | 582.5 | 11.387117 | 1.5163e-29 | 1.00000 | N | 0.077597 | 0.016857 |
| ExxxMD | HhhhEC | 16.7 | 0.2 | 36.2 | 35.393181 | 6.7544e-27 | 1.00000 | B | 0.461326 | 0.006027 |
| GxxxST | CcchHH | 41.3 | 9.3 | 215.2 | 10.727154 | 2.2945e-26 | 1.00000 | N | 0.191914 | 0.043218 |
| GxxxTT | CcchHH | 45.0 | 10.8 | 228.6 | 10.664870 | 3.9274e-26 | 1.00000 | N | 0.196850 | 0.047226 |
| LxxxGK | CcccCH | 29.0 | 1.9 | 120.0 | 20.108167 | 4.1285e-26 | 1.00000 | B | 0.241667 | 0.015428 |
| SxxxDK | CeeeEE | 60.1 | 17.8 | 256.6 | 10.374931 | 5.7844e-25 | 1.00000 | N | 0.234217 | 0.069505 |
| PxxxIG | CeecCC | 14.3 | 0.2 | 13.4 | 29.692131 | 3.6368e-24 | 1.00000 | B | 1.067164 | 0.014972 |
| SxxxKS | CcccHH | 28.0 | 5.2 | 140.5 | 10.214096 | 8.4052e-24 | 1.00000 | N | 0.199268 | 0.036881 |
| LxxxVM | CchhHH | 23.7 | 1.4 | 59.7 | 19.223495 | 6.7876e-23 | 1.00000 | B | 0.396985 | 0.023116 |
| VxxxNG | EcccCC | 29.1 | 5.8 | 121.9 | 9.970960 | 8.5736e-23 | 1.00000 | N | 0.238720 | 0.047201 |
| DxxxGK | CcccCH | 35.1 | 4.2 | 204.5 | 15.193499 | 9.8658e-22 | 1.00000 | B | 0.171638 | 0.020627 |
| YxxxNE | HhhhHH | 27.3 | 5.5 | 107.9 | 9.499449 | 8.3765e-21 | 1.00000 | N | 0.253012 | 0.051287 |
| DxxxKT | CcccHH | 24.5 | 2.0 | 64.1 | 15.998384 | 4.4565e-20 | 1.00000 | B | 0.382215 | 0.031767 |

TABLE 21-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| QxxxLG | CcccHH | 18.4 | 0.9 | 36.3 | 18.490167 | 7.6666e-20 | 1.00000 | B | 0.506887 | 0.025267 |
| QxxxWY | HhhhHC | 11.5 | 0.3 | 11.1 | 20.996615 | 2.3636e-18 | 1.00000 | B | 1.036036 | 0.024560 |
| YxxxFQ | CcccCC | 18.6 | 1.1 | 41.8 | 16.836828 | 3.0671e-18 | 1.00000 | B | 0.444976 | 0.026523 |
| AxxxGI | HhhhCC | 29.9 | 6.9 | 432.7 | 8.779901 | 4.3999e-18 | 1.00000 | N | 0.069101 | 0.016053 |
| CxxxIC | EcccCC | 7.0 | 0.0 | 12.0 | 50.227535 | 2.2267e-17 | 1.00000 | B | 0.583333 | 0.001612 |
| TxxxKK | EeeeEE | 69.9 | 27.5 | 416.3 | 8.363251 | 7.0078e-17 | 1.00000 | N | 0.167908 | 0.066081 |
| MxxxDA | HhccCH | 1.0 | 0.0 | 1.0 | 5.293417 | 1.0720e-16 | 1.00000 | B | 1.000000 | 0.034459 |
| QxxxSL | EeccEE | 27.9 | 6.7 | 256.2 | 8.321559 | 2.2276e-16 | 1.00000 | N | 0.108899 | 0.026065 |
| LxxxYH | HhhhHH | 29.3 | 4.2 | 149.9 | 12.332883 | 2.6305e-16 | 1.00000 | N | 0.195464 | 0.028332 |
| RxxxPE | HhhcCC | 28.5 | 7.2 | 111.5 | 8.193404 | 6.1741e-16 | 1.00000 | N | 0.255605 | 0.064712 |
| QxxxGS | CcccEC | 11.5 | 0.3 | 38.4 | 20.426447 | 4.2192e-15 | 1.00000 | B | 0.299479 | 0.007887 |
| WxxxFT | HhhcCC | 9.4 | 0.2 | 17.9 | 23.668916 | 6.5801e-15 | 1.00000 | B | 0.525140 | 0.008599 |
| SxxxGR | CcccHH | 15.8 | 1.0 | 67.1 | 15.237596 | 9.2692e-15 | 1.00000 | B | 0.235469 | 0.014337 |
| NxxxGK | CcccCC | 16.9 | 1.3 | 53.7 | 14.061590 | 1.1001e-14 | 1.00000 | B | 0.314711 | 0.023575 |
| NxxxQF | CcccCE | 17.8 | 1.5 | 51.1 | 13.545332 | 1.1983e-14 | 1.00000 | B | 0.348337 | 0.029216 |
| YxxxRT | HhccCC | 18.3 | 1.9 | 47.4 | 12.329519 | 5.9076e-14 | 1.00000 | B | 0.386076 | 0.039072 |
| SxxxVD | HceeEE | 58.7 | 23.5 | 333.5 | 7.513806 | 6.4629e-14 | 1.00000 | N | 0.176012 | 0.070611 |
| ExxxAE | HhhhHH | 82.6 | 37.8 | 768.2 | 7.460296 | 8.0982e-14 | 1.00000 | N | 0.107524 | 0.049269 |
| KxxxLD | HhccCC | 25.2 | 6.4 | 158.0 | 7.548711 | 1.0095e-13 | 1.00000 | N | 0.159494 | 0.040754 |
| KxxxCK | EeecCC | 17.6 | 1.7 | 48.7 | 12.382741 | 1.5752e-13 | 1.00000 | B | 0.361396 | 0.035054 |
| CxxxYR | HhhhHC | 10.0 | 0.4 | 12.5 | 15.304518 | 1.7261e-13 | 1.00000 | B | 0.800000 | 0.032492 |
| RxxxGL | HhhhCC | 28.6 | 8.1 | 176.7 | 7.393568 | 2.7275e-13 | 1.00000 | N | 0.161856 | 0.045701 |
| QxxxCW | CcccHH | 7.9 | 0.1 | 20.2 | 25.982292 | 3.1500e-13 | 1.00000 | B | 0.391089 | 0.004492 |
| AxxxGK | CcccCH | 14.4 | 1.0 | 93.3 | 13.642109 | 8.6294e-13 | 1.00000 | B | 0.154341 | 0.010485 |
| ExxxAL | HhhhHC | 32.2 | 10.0 | 257.3 | 7.160501 | 1.2869e-12 | 1.00000 | N | 0.125146 | 0.038867 |
| PxxxSA | CceeEE | 21.1 | 5.1 | 180.5 | 7.181197 | 1.7416e-12 | 1.00000 | N | 0.116898 | 0.028284 |
| DxxxNG | CcccCC | 41.8 | 14.9 | 391.2 | 7.084546 | 1.7924e-12 | 1.00000 | N | 0.106851 | 0.038196 |
| GxxxSA | CcchHH | 24.6 | 6.6 | 185.4 | 7.117102 | 2.2711e-12 | 1.00000 | N | 0.132686 | 0.035702 |
| RxxxDS | HhheCC | 16.7 | 1.8 | 45.2 | 11.428338 | 2.6297e-12 | 1.00000 | B | 0.369469 | 0.039275 |
| SxxxNT | CcccCC | 12.5 | 0.8 | 23.9 | 12.925110 | 3.2732e-12 | 1.00000 | B | 0.523013 | 0.035277 |
| QxxxGK | CcccCH | 13.5 | 0.9 | 58.5 | 13.107957 | 4.1790e-12 | 1.00000 | B | 0.230769 | 0.015965 |
| RxxxTG | EeccCC | 24.8 | 6.9 | 127.8 | 7.018198 | 4.4794e-12 | 1.00000 | N | 0.194053 | 0.053883 |
| GxxxDF | EeccEE | 25.3 | 7.0 | 248.3 | 6.995039 | 5.0997e-12 | 1.00000 | N | 0.101893 | 0.028291 |
| DxxxGS | HhhhCC | 20.9 | 3.3 | 65.1 | 9.930092 | 8.3751e-12 | 1.00000 | B | 0.321045 | 0.050797 |
| CxxxVG | CcccCC | 6.8 | 0.1 | 20.0 | 26.127329 | 1.0463e-11 | 1.00000 | B | 0.340000 | 0.003332 |
| SxxxGC | EeccCC | 15.3 | 1.4 | 138.8 | 11.769743 | 1.3088e-11 | 1.00000 | B | 0.110231 | 0.010141 |
| VxxxCI | HhccCH | 4.0 | 0.0 | 6.5 | 53.088891 | 1.3520e-11 | 1.00000 | B | 0.615385 | 0.000872 |
| ExxxSK | HhhhHH | 43.5 | 16.6 | 292.1 | 6.778914 | 1.4388e-11 | 1.00000 | N | 0.148922 | 0.056980 |
| QxxxKT | CcccCC | 10.2 | 0.5 | 24.8 | 13.423552 | 3.5602e-11 | 1.00000 | B | 0.411290 | 0.021381 |
| AxxxGA | HhhhCC | 26.9 | 8.1 | 515.8 | 6.675596 | 4.0624e-11 | 1.00000 | N | 0.052152 | 0.015659 |
| WxxxYA | CcccHH | 5.0 | 0.0 | 5.3 | 25.164503 | 4.1132e-11 | 1.00000 | B | 0.943396 | 0.007387 |
| NxxxDK | CeeeEE | 29.8 | 9.8 | 140.6 | 6.628627 | 5.1332e-11 | 1.00000 | N | 0.211949 | 0.069648 |
| FxxxLT | HhhhHH | 24.1 | 6.8 | 425.0 | 6.631623 | 6.0285e-11 | 1.00000 | N | 0.056741 | 0.016048 |
| AxxxGL | HhhhCC | 28.1 | 8.8 | 473.3 | 6.596022 | 6.5719e-11 | 1.00000 | N | 0.059370 | 0.018507 |
| NxxxGG | CchhHC | 9.3 | 0.5 | 16.8 | 13.308464 | 9.4341e-11 | 1.00000 | B | 0.553571 | 0.027028 |
| RxxxTD | HcccCC | 22.6 | 4.5 | 69.1 | 8.886497 | 9.5799e-11 | 1.00000 | B | 0.327062 | 0.064487 |
| KxxxCH | HcccCC | 10.6 | 0.7 | 19.9 | 12.354520 | 9.7646e-11 | 1.00000 | B | 0.532663 | 0.033601 |
| SxxxGR | CcccCH | 12.7 | 1.0 | 40.8 | 11.522791 | 1.0549e-10 | 1.00000 | B | 0.311275 | 0.025718 |
| SxxxCW | CcecHH | 5.7 | 0.0 | 11.5 | 27.570955 | 1.2129e-10 | 1.00000 | B | 0.495652 | 0.003675 |
| RxxxAE | HhhhHH | 57.2 | 25.4 | 630.5 | 6.432535 | 1.2154e-10 | 1.00000 | N | 0.090722 | 0.040326 |
| LxxxGV | HhhhCC | 23.0 | 6.6 | 445.9 | 6.430619 | 2.2726e-10 | 1.00000 | N | 0.051593 | 0.014805 |
| YxxxNR | EcccEE | 19.8 | 5.4 | 85.3 | 6.438949 | 2.5510e-10 | 1.00000 | N | 0.232122 | 0.062882 |
| PxxxGK | CcccCH | 20.8 | 3.6 | 194.8 | 9.202084 | 2.5628e-10 | 1.00000 | B | 0.106776 | 0.018331 |
| QxxxYG | CcccHH | 13.3 | 1.4 | 40.0 | 10.338918 | 3.4539e-10 | 1.00000 | B | 0.332500 | 0.034432 |
| MxxxKF | HcccCE | 7.5 | 0.2 | 14.3 | 15.600641 | 4.0462e-10 | 1.00000 | B | 0.524476 | 0.015462 |
| PxxxAL | CchhHC | 12.4 | 1.2 | 28.2 | 10.320780 | 4.9428e-10 | 1.00000 | B | 0.439716 | 0.043459 |
| QxxxCH | HhhhHH | 13.0 | 1.5 | 31.0 | 9.683104 | 6.3845e-10 | 1.00000 | B | 0.419355 | 0.047912 |
| AxxxNF | CcccCE | 8.6 | 0.4 | 31.7 | 13.879215 | 8.1895e-10 | 1.00000 | B | 0.271293 | 0.011254 |
| NxxxNR | HhchHH | 13.9 | 1.6 | 49.3 | 9.721101 | 1.0469e-09 | 1.00000 | B | 0.281947 | 0.033353 |
| NxxxLM | CcccCE | 5.0 | 0.1 | 6.3 | 19.458847 | 1.0490e-09 | 1.00000 | B | 0.793651 | 0.010316 |
| RxxxGL | CeccEC | 6.2 | 0.2 | 6.0 | 13.456025 | 1.0888e-09 | 1.00000 | B | 1.033333 | 0.032074 |
| NxxxTT | CcchHH | 15.8 | 2.3 | 52.5 | 9.154042 | 1.1764e-09 | 1.00000 | B | 0.300952 | 0.043434 |
| KxxxQK | EeccCC | 8.2 | 0.5 | 9.5 | 10.982772 | 1.2202e-09 | 1.00000 | B | 0.863158 | 0.054473 |
| KxxxGK | HhhhCC | 30.7 | 11.1 | 167.2 | 6.107252 | 1.3267e-09 | 1.00000 | N | 0.183612 | 0.066190 |
| RxxxGL | HhhcCC | 21.0 | 6.1 | 160.0 | 6.156651 | 1.3396e-09 | 1.00000 | N | 0.131250 | 0.038087 |
| ExxxAQ | HhhhHH | 43.6 | 18.2 | 430.8 | 6.069188 | 1.3445e-09 | 1.00000 | N | 0.101207 | 0.042332 |
| RxxxGK | HhhhCC | 20.0 | 5.8 | 92.2 | 6.130584 | 1.6557e-09 | 1.00000 | N | 0.216920 | 0.062441 |
| ExxxSR | HhhhHH | 34.5 | 13.2 | 256.4 | 6.044594 | 1.7844e-09 | 1.00000 | N | 0.134555 | 0.051287 |
| MxxxRN | HhhhCC | 15.6 | 2.2 | 66.5 | 9.152082 | 1.8995e-09 | 1.00000 | B | 0.234586 | 0.033281 |
| GxxxAH | ChhhHH | 11.0 | 1.0 | 33.0 | 10.168580 | 2.0150e-09 | 1.00000 | B | 0.333333 | 0.030234 |
| HxxxGK | CcccCH | 9.0 | 0.5 | 49.3 | 11.829852 | 2.3778e-09 | 1.00000 | B | 0.182556 | 0.010535 |
| NxxxSR | HhhcCH | 11.2 | 1.1 | 22.1 | 9.635067 | 2.6454e-09 | 1.00000 | B | 0.506787 | 0.051948 |
| AxxxQK | HhhhCE | 18.1 | 3.5 | 52.2 | 8.157327 | 2.7384e-09 | 1.00000 | B | 0.346743 | 0.066142 |
| QxxxGI | HhhhCC | 19.5 | 5.6 | 117.8 | 5.976186 | 4.1929e-09 | 1.00000 | N | 0.165535 | 0.047922 |
| CxxxIG | CcccCH | 4.8 | 0.0 | 12.4 | 27.010872 | 4.6438e-09 | 1.00000 | B | 0.387097 | 0.002520 |
| ExxxSK | EcccCE | 14.4 | 2.0 | 50.5 | 8.850457 | 5.1816e-09 | 1.00000 | B | 0.285149 | 0.040279 |
| SxxxSL | HhhhHC | 17.8 | 3.1 | 114.3 | 8.385299 | 5.7237e-09 | 1.00000 | B | 0.155731 | 0.027490 |

TABLE 21-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxxxKT | CcccHH | 18.5 | 3.4 | 134.6 | 8.307329 | 5.8961e−09 | 1.00000 | B | 0.137444 | 0.025205 |
| RxxxQR | HhhhHH | 33.7 | 13.2 | 228.4 | 5.794345 | 7.8947e−09 | 1.00000 | N | 0.147548 | 0.057959 |
| KxxxPG | HhhcCC | 28.5 | 10.4 | 157.6 | 5.811554 | 7.9723e−09 | 1.00000 | N | 0.180838 | 0.065945 |
| AxxxCH | CchhHH | 6.0 | 0.1 | 5.0 | 14.128524 | 8.7129e−09 | 1.00000 | B | 1.200000 | 0.024436 |
| RxxxGG | HhhhCC | 20.3 | 4.5 | 85.3 | 7.694509 | 9.8975e−09 | 1.00000 | B | 0.237984 | 0.052377 |
| AxxxRH | HhhhHH | 29.4 | 10.9 | 245.6 | 5.749860 | 1.1049e−08 | 1.00000 | N | 0.119707 | 0.044253 |
| CxxxIG | CcccCC | 9.5 | 0.7 | 40.6 | 10.749424 | 1.1320e−08 | 1.00000 | B | 0.233990 | 0.016851 |

TABLE 22

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxxKxT | CccHhH | 83.1 | 9.8 | 353.1 | 23.760777 | 1.9863e−123 | 1.00000 | N | 0.235344 | 0.027728 |
| TxxGxT | CccChH | 46.6 | 5.5 | 140.5 | 17.925581 | 1.8308e−70 | 1.00000 | N | 0.331673 | 0.038978 |
| VxxKxG | EccCcC | 41.9 | 6.3 | 138.2 | 14.475018 | 1.6458e−46 | 1.00000 | N | 0.303184 | 0.045794 |
| SxxVxK | CeeEeE | 65.3 | 16.6 | 303.8 | 12.309323 | 1.9144e−34 | 1.00000 | N | 0.214944 | 0.054555 |
| QxxGxG | CccChH | 34.0 | 2.7 | 61.5 | 19.639877 | 3.0967e−30 | 1.00000 | B | 0.552846 | 0.043273 |
| DxxGxG | CccCcC | 95.4 | 33.3 | 1003.2 | 10.953878 | 8.3945e−28 | 1.00000 | N | 0.095096 | 0.033166 |
| CxxGxT | CccCcC | 36.2 | 3.3 | 126.6 | 18.275052 | 5.0452e−27 | 1.00000 | B | 0.285940 | 0.026253 |
| RxxDxD | HhhCcC | 36.6 | 7.6 | 188.0 | 10.735002 | 2.5428e−26 | 1.00000 | N | 0.194681 | 0.040444 |
| DxxGxT | CccChH | 25.3 | 1.6 | 63.1 | 19.072943 | 7.2871e−24 | 1.00000 | B | 0.400951 | 0.025131 |
| PxxLxV | CceEeE | 32.3 | 6.5 | 409.9 | 10.154812 | 1.1669e−23 | 1.00000 | N | 0.078800 | 0.015954 |
| TxxDxK | EeeEeE | 71.3 | 24.2 | 396.7 | 9.891898 | 6.4050e−23 | 1.00000 | N | 0.179733 | 0.060932 |
| PxxNxG | CeeCcC | 15.5 | 0.3 | 24.8 | 26.829701 | 6.7903e−23 | 1.00000 | B | 0.625000 | 0.013072 |
| DxxVxK | CccCcH | 23.6 | 1.5 | 120.5 | 18.328477 | 4.2756e−21 | 1.00000 | B | 0.195851 | 0.012242 |
| LxxLxT | HhhChH | 14.7 | 0.4 | 21.1 | 23.070139 | 2.0329e−20 | 1.00000 | B | 0.696682 | 0.018575 |
| FxxHxA | CccHhH | 11.6 | 0.2 | 19.0 | 27.924333 | 7.9156e−19 | 1.00000 | B | 0.610526 | 0.008899 |
| RxxGxG | CccChH | 24.2 | 2.4 | 63.5 | 14.513003 | 1.7368e−18 | 1.00000 | B | 0.381102 | 0.037058 |
| LxxNxM | CchHhH | 18.1 | 1.0 | 44.6 | 17.173637 | 1.8356e−18 | 1.00000 | B | 0.405830 | 0.022712 |
| SxxGxT | CccChH | 30.5 | 4.0 | 129.8 | 13.540361 | 2.3842e−18 | 1.00000 | B | 0.234977 | 0.030525 |
| NxxKxT | CccHhH | 23.8 | 2.3 | 62.4 | 14.345065 | 6.0409e−18 | 1.00000 | B | 0.381410 | 0.037298 |
| SxxKxD | HceEeE | 57.0 | 19.8 | 313.1 | 8.642784 | 7.5321e−18 | 1.00000 | N | 0.182050 | 0.063201 |
| YxxGxT | HhcCcC | 22.1 | 2.2 | 65.5 | 13.586630 | 1.4379e−16 | 1.00000 | B | 0.337405 | 0.033843 |
| CxxGxG | CccCcC | 10.3 | 0.1 | 51.3 | 27.308055 | 1.8238e−16 | 1.00000 | B | 0.200780 | 0.002706 |
| DxxGxP | HhhCcC | 33.8 | 9.3 | 183.0 | 8.241246 | 3.4292e−16 | 1.00000 | N | 0.184699 | 0.050855 |
| LxxKxY | HhhCcC | 22.3 | 2.4 | 89.2 | 13.024128 | 1.5264e−15 | 1.00000 | B | 0.250000 | 0.026898 |
| GxxKxS | CccHhH | 24.1 | 2.9 | 119.6 | 12.606859 | 1.6128e−15 | 1.00000 | B | 0.201505 | 0.024235 |
| ExxGxS | HhhCcC | 35.4 | 10.4 | 185.6 | 7.959755 | 3.0861e−15 | 1.00000 | N | 0.190733 | 0.056187 |
| KxxFxV | HhcCcH | 11.6 | 0.4 | 15.8 | 17.893079 | 3.6601e−15 | 1.00000 | B | 0.734177 | 0.025436 |
| LxxAxK | CccCcH | 14.8 | 0.8 | 60.2 | 15.943519 | 9.6061e−15 | 1.00000 | B | 0.245847 | 0.013008 |
| RxxMxS | HhhEcC | 16.7 | 1.3 | 42.2 | 13.801893 | 1.5849e−14 | 1.00000 | B | 0.395735 | 0.030483 |
| MxxFxF | HccCcE | 7.5 | 0.1 | 12.0 | 30.033887 | 3.6712e−14 | 1.00000 | B | 0.625000 | 0.005138 |
| MxxCxL | EecCcC | 7.0 | 0.1 | 10.0 | 26.697096 | 7.8298e−14 | 1.00000 | B | 0.700000 | 0.006788 |
| YxxNxQ | CccCcC | 22.9 | 3.2 | 83.7 | 11.126181 | 1.4659e−13 | 1.00000 | B | 0.273596 | 0.038784 |
| KxxGxD | HhhCcC | 46.7 | 17.0 | 284.7 | 7.415308 | 1.5458e−13 | 1.00000 | N | 0.164032 | 0.059814 |
| AxxGxP | HhcCcC | 32.9 | 9.9 | 247.6 | 7.451189 | 1.5600e−13 | 1.00000 | N | 0.132876 | 0.040039 |
| KxxGxN | HhcCcC | 33.4 | 10.3 | 186.4 | 7.375182 | 2.6922e−13 | 1.00000 | N | 0.179185 | 0.055503 |
| SxxGxS | CccChH | 26.0 | 4.6 | 127.5 | 10.143807 | 8.1010e−13 | 1.00000 | B | 0.203922 | 0.036176 |
| NxxCxN | EecCcC | 14.5 | 1.1 | 43.0 | 12.726677 | 1.5589e−12 | 1.00000 | B | 0.337209 | 0.026349 |
| AxxKxT | CccHhH | 14.5 | 1.2 | 45.7 | 12.548421 | 2.4406e−12 | 1.00000 | B | 0.317287 | 0.025375 |
| GxxGxC | CccCcH | 13.3 | 0.9 | 44.9 | 12.905411 | 3.8622e−12 | 1.00000 | B | 0.296214 | 0.020874 |
| SxxAxW | CceChH | 5.2 | 0.0 | 5.0 | 29.896993 | 5.3267e−12 | 1.00000 | B | 1.040000 | 0.005563 |
| KxxGxP | HhhCcC | 39.7 | 14.3 | 276.0 | 6.907485 | 6.3677e−12 | 1.00000 | N | 0.143841 | 0.051742 |
| RxxGxA | HhhCcC | 21.2 | 5.4 | 114.5 | 6.985745 | 6.6680e−12 | 1.00000 | N | 0.185153 | 0.046994 |
| RxxDxS | EccCcC | 20.5 | 5.1 | 138.7 | 6.971130 | 7.6462e−12 | 1.00000 | N | 0.147801 | 0.036621 |
| ExxPxD | HhcCcC | 20.1 | 5.1 | 88.6 | 6.882766 | 1.4270e−11 | 1.00000 | N | 0.226862 | 0.057140 |
| RxxGxP | HhhCcC | 35.0 | 12.1 | 274.9 | 6.707417 | 2.6783e−11 | 1.00000 | N | 0.127319 | 0.044184 |
| NxxGxS | CecCeC | 18.6 | 2.8 | 49.7 | 9.784163 | 3.5481e−11 | 1.00000 | B | 0.374245 | 0.055768 |
| ExxGxS | HhcCcC | 24.9 | 7.3 | 129.6 | 6.682720 | 4.2194e−11 | 1.00000 | N | 0.192130 | 0.056545 |
| SxxWxS | CccCcC | 23.6 | 6.7 | 200.2 | 6.644325 | 5.6746e−11 | 1.00000 | N | 0.117882 | 0.033448 |
| RxxGxN | HhcCcC | 27.5 | 8.6 | 166.0 | 6.600575 | 6.5622e−11 | 1.00000 | N | 0.165663 | 0.051959 |
| SxxIxR | CccCcH | 9.7 | 0.4 | 26.0 | 14.293879 | 6.8602e−11 | 1.00000 | B | 0.373077 | 0.016455 |
| GxxFxI | EccEeE | 8.2 | 0.3 | 14.4 | 14.787675 | 8.3777e−11 | 1.00000 | B | 0.569444 | 0.020271 |
| NxxVxK | CeeEeE | 31.3 | 10.6 | 203.1 | 6.545306 | 8.4370e−11 | 1.00000 | N | 0.154111 | 0.052072 |
| TxxLxK | CccCcH | 12.8 | 1.1 | 41.4 | 11.514712 | 9.3815e−11 | 1.00000 | B | 0.309179 | 0.025747 |
| ExxGxP | HhcCcC | 32.8 | 11.5 | 226.1 | 6.450292 | 1.4987e−10 | 1.00000 | N | 0.145069 | 0.050838 |
| MxxSxN | HhhHcC | 14.4 | 1.5 | 54.6 | 10.544362 | 1.5677e−10 | 1.00000 | B | 0.263736 | 0.028063 |
| CxxNxC | EccCcC | 7.6 | 0.2 | 27.4 | 17.711018 | 1.6978e−10 | 1.00000 | B | 0.277203 | 0.006453 |
| KxxGxN | HhhCcC | 32.1 | 11.2 | 196.9 | 6.425281 | 1.7880e−10 | 1.00000 | N | 0.163027 | 0.056929 |
| SxxIxR | CccChH | 7.5 | 0.2 | 22.9 | 16.857018 | 2.8617e−10 | 1.00000 | B | 0.327511 | 0.008281 |
| ExxLxY | HhhHhC | 17.0 | 2.5 | 69.1 | 9.239619 | 4.0465e−10 | 1.00000 | B | 0.246020 | 0.036788 |
| GxxKxA | CccHhH | 21.1 | 3.9 | 165.6 | 8.815648 | 4.6376e−10 | 1.00000 | B | 0.127415 | 0.023544 |
| RxxTxK | HhcCcC | 14.5 | 1.9 | 33.2 | 9.273239 | 9.5076e−10 | 1.00000 | B | 0.436747 | 0.058635 |

TABLE 22-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| SxxTxC | HhhCcE | 5.3 | 0.0 | 4.0 | 26.740684 | 9.5757e−10 | 1.00000 | B | 1.325000 | 0.005563 |
| RxxGxV | HhhCcC | 19.6 | 3.6 | 103.7 | 8.613509 | 1.4059e−09 | 1.00000 | B | 0.189007 | 0.034542 |
| ExxGxV | HhhCcC | 21.1 | 4.3 | 110.4 | 8.311882 | 1.4089e−09 | 1.00000 | B | 0.191123 | 0.038646 |
| AxxGxA | HhhCcC | 20.9 | 6.1 | 152.0 | 6.130139 | 1.5782e−09 | 1.00000 | N | 0.137500 | 0.040030 |
| TxxGxT | EecCeE | 29.0 | 10.2 | 184.0 | 6.076901 | 1.6537e−09 | 1.00000 | N | 0.157609 | 0.055253 |
| QxxTxK | CccCcH | 7.5 | 0.2 | 21.1 | 14.590222 | 1.7420e−09 | 1.00000 | B | 0.355450 | 0.011843 |
| PxxSxK | CccCcH | 11.0 | 0.9 | 71.6 | 10.601684 | 2.0925e−09 | 1.00000 | B | 0.153631 | 0.012799 |
| NxxPxR | HhcHhH | 13.9 | 1.8 | 59.3 | 9.320763 | 2.9671e−09 | 1.00000 | B | 0.234401 | 0.029523 |
| DxxTxT | EccCcE | 19.9 | 3.9 | 104.8 | 8.202127 | 3.2719e−09 | 1.00000 | B | 0.189885 | 0.037557 |
| PxxGxS | HhhCeC | 7.4 | 0.4 | 8.5 | 11.674578 | 3.5192e−09 | 1.00000 | B | 0.870588 | 0.044539 |
| ExxGxL | HhcCcC | 20.8 | 4.3 | 112.8 | 8.112994 | 3.5599e−09 | 1.00000 | B | 0.184397 | 0.038122 |
| AxxGxS | HhhCcC | 26.8 | 9.2 | 190.0 | 5.946894 | 3.7813e−09 | 1.00000 | N | 0.141053 | 0.048433 |
| QxxCxS | CccCeC | 5.1 | 0.1 | 38.9 | 20.782682 | 3.9101e−09 | 1.00000 | B | 0.131105 | 0.001515 |
| LxxSxK | CccCcH | 9.0 | 0.6 | 47.6 | 11.386026 | 4.1886e−09 | 1.00000 | B | 0.189076 | 0.011690 |
| FxxAxN | CchHhH | 7.8 | 0.3 | 17.0 | 12.974151 | 4.3718e−09 | 1.00000 | B | 0.458824 | 0.019855 |
| RxxGxE | HhcCcC | 30.2 | 11.2 | 186.3 | 5.834341 | 6.7156e−09 | 1.00000 | N | 0.162104 | 0.060330 |
| AxxGxP | HhhCcC | 32.6 | 12.5 | 323.5 | 5.818734 | 6.9638e−09 | 1.00000 | N | 0.100773 | 0.038516 |
| NxxDxD | HhhCcC | 14.0 | 2.0 | 57.2 | 8.641401 | 7.8927e−09 | 1.00000 | B | 0.244755 | 0.034942 |
| RxxGxP | HhcCcC | 27.1 | 9.6 | 187.1 | 5.799118 | 8.8328e−09 | 1.00000 | N | 0.144842 | 0.051307 |
| CxxGxM | HhcCcH | 8.0 | 0.4 | 26.4 | 11.413436 | 8.9920e−09 | 1.00000 | B | 0.303030 | 0.016879 |
| LxxGxR | HhcCcC | 19.7 | 5.8 | 175.5 | 5.837346 | 9.1774e−09 | 1.00000 | N | 0.112251 | 0.033250 |
| DxxExG | EeeEcC | 15.2 | 2.5 | 65.7 | 8.298279 | 1.2842e−08 | 1.00000 | B | 0.231355 | 0.037315 |
| QxxSxW | CccChH | 6.1 | 0.2 | 25.7 | 14.525392 | 1.3369e−08 | 1.00000 | B | 0.237354 | 0.006532 |
| IxxGxL | HhhCcC | 16.6 | 2.8 | 119.7 | 8.281164 | 1.3631e−08 | 1.00000 | B | 0.138680 | 0.023654 |
| FxxMxR | ChhHhH | 9.7 | 0.8 | 22.6 | 10.065010 | 1.3976e−08 | 1.00000 | B | 0.429204 | 0.035808 |
| LxxAxK | EccCcH | 7.0 | 0.3 | 14.5 | 11.645568 | 1.4353e−08 | 1.00000 | B | 0.482759 | 0.023123 |
| LxxPxY | CccCcC | 20.5 | 6.3 | 212.2 | 5.742644 | 1.5087e−08 | 1.00000 | N | 0.096607 | 0.029693 |
| ExxGxW | CccCcE | 9.0 | 0.7 | 32.0 | 10.221785 | 1.5374e−08 | 1.00000 | B | 0.281250 | 0.021165 |
| NxxCxS | CceEeC | 5.5 | 0.1 | 5.5 | 14.257524 | 1.6946e−08 | 1.00000 | B | 1.000000 | 0.026344 |
| GxxPxW | CceCcC | 6.0 | 0.3 | 7.0 | 11.416331 | 1.8807e−08 | 1.00000 | B | 0.857143 | 0.037489 |
| RxxGxS | HhcCcC | 22.0 | 7.2 | 126.2 | 5.687773 | 1.9453e−08 | 1.00000 | N | 0.174326 | 0.056971 |
| AxxGxT | HhcCcC | 20.6 | 6.5 | 145.6 | 5.653943 | 2.4711e−08 | 1.00000 | N | 0.141484 | 0.044679 |
| DxxExL | EhhHhH | 13.6 | 1.9 | 70.0 | 8.562336 | 2.4756e−08 | 1.00000 | B | 0.194286 | 0.027355 |
| ExxGxE | HhhCcC | 33.2 | 13.4 | 223.9 | 5.576582 | 2.7286e−08 | 1.00000 | N | 0.148280 | 0.059866 |
| KxxHxY | HhhCcC | 7.0 | 0.4 | 11.3 | 10.460323 | 3.2212e−08 | 1.00000 | B | 0.619469 | 0.036433 |
| PxxSxE | CccChH | 34.3 | 14.1 | 270.2 | 5.539452 | 3.2852e−08 | 1.00000 | N | 0.126943 | 0.052072 |
| GxxTxY | CccEeE | 18.5 | 5.6 | 135.9 | 5.610971 | 3.4396e−08 | 1.00000 | N | 0.136130 | 0.040853 |
| ExxGxR | HhcCcC | 18.1 | 5.4 | 95.5 | 5.613533 | 3.4784e−08 | 1.00000 | N | 0.189529 | 0.056691 |

TABLE 23

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| TxxGKT | CccCHH | 42.4 | 2.6 | 117.2 | 24.985498 | 4.7047e−39 | 1.00000 | B | 0.361775 | 0.022146 |
| SxxVDK | CeeEEE | 59.1 | 13.1 | 253.5 | 13.080308 | 1.3690e−38 | 1.00000 | N | 0.233136 | 0.051524 |
| DxxGKT | CccCHH | 24.3 | 0.5 | 45.9 | 35.121431 | 5.7625e−36 | 1.00000 | B | 0.529412 | 0.010137 |
| TxxDKK | EeeEEE | 69.9 | 18.8 | 364.0 | 12.105623 | 2.0737e−33 | 1.00000 | N | 0.192033 | 0.051630 |
| GxxKTT | CccCHH | 37.1 | 3.0 | 141.8 | 19.967429 | 1.5635e−29 | 1.00000 | B | 0.261636 | 0.021032 |
| YxxNFQ | CccCCC | 18.6 | 0.4 | 22.6 | 30.533644 | 3.4603e−29 | 1.00000 | B | 0.823009 | 0.016043 |
| GxxKST | CccHHH | 30.9 | 2.1 | 110.3 | 19.885548 | 1.1670e−26 | 1.00000 | B | 0.280145 | 0.019346 |
| QxxGLG | CccCHH | 16.0 | 0.4 | 16.7 | 24.595142 | 1.4620e−25 | 1.00000 | B | 0.958084 | 0.024661 |
| DxxVGK | CccCCH | 20.6 | 0.6 | 102.6 | 24.935978 | 2.1888e−24 | 1.00000 | B | 0.200780 | 0.006281 |
| LxxAGK | CccCCH | 14.8 | 0.2 | 46.4 | 35.352560 | 4.6640e−24 | 1.00000 | B | 0.318966 | 0.003704 |
| SxxKVD | HceEEE | 56.5 | 16.4 | 313.0 | 10.172335 | 4.8080e−24 | 1.00000 | N | 0.180511 | 0.052395 |
| SxxIGR | CccCCH | 9.7 | 0.0 | 14.7 | 71.755345 | 7.9503e−24 | 1.00000 | B | 0.659864 | 0.001240 |
| SxxGKS | CccCHH | 25.0 | 1.5 | 91.5 | 19.260012 | 1.8449e−23 | 1.00000 | B | 0.273224 | 0.016527 |
| SxxGNT | CccCHH | 12.5 | 0.1 | 11.0 | 31.354824 | 3.0442e−22 | 1.00000 | B | 1.136364 | 0.011065 |
| LxxNVM | CchHHH | 18.1 | 0.7 | 30.9 | 20.921107 | 3.8340e−22 | 1.00000 | B | 0.585761 | 0.022891 |
| RxxMDS | HhhECC | 16.7 | 0.4 | 42.2 | 24.919014 | 6.1180e−22 | 1.00000 | B | 0.395735 | 0.010205 |
| CxxNIC | EccCCC | 7.0 | 0.0 | 12.0 | 90.555035 | 5.9489e−21 | 1.00000 | B | 0.583333 | 0.000497 |
| NxxKTT | CccHHH | 15.8 | 0.5 | 24.1 | 20.868377 | 5.3869e−20 | 1.00000 | B | 0.655602 | 0.022683 |
| PxxNIG | CeeCCC | 14.3 | 0.1 | 10.3 | 29.833145 | 6.0708e−20 | 1.00000 | B | 1.388350 | 0.011440 |
| DxxGDG | CccCCC | 32.8 | 7.6 | 245.6 | 9.251579 | 6.0747e−20 | 1.00000 | N | 0.133550 | 0.031090 |
| VxxKNG | EccCCC | 26.6 | 2.8 | 57.3 | 14.434463 | 1.7747e−19 | 1.00000 | B | 0.464223 | 0.049723 |
| CxxGIG | CccCCC | 6.3 | 0.0 | 11.9 | 112.413301 | 2.0360e−19 | 1.00000 | B | 0.529412 | 0.000264 |
| YxxGRT | HhcCCC | 18.3 | 1.0 | 35.4 | 17.340206 | 5.1270e−19 | 1.00000 | B | 0.516949 | 0.028879 |
| SxxIGR | CccCHH | 7.3 | 0.0 | 20.2 | 61.430311 | 4.6706e−18 | 1.00000 | B | 0.361386 | 0.000697 |
| NxxVDK | CeeEEE | 29.8 | 7.1 | 135.8 | 8.714799 | 7.8056e−18 | 1.00000 | N | 0.219440 | 0.052559 |
| SxxVGR | CccCHH | 8.3 | 0.0 | 20.1 | 43.587327 | 9.6557e−18 | 1.00000 | B | 0.412935 | 0.001792 |
| NxxVDN | CeeECC | 1.0 | 0.0 | 1.0 | 5.018033 | 1.0678e−16 | 1.00000 | B | 1.000000 | 0.038196 |
| QxxFHI | HhhHCC | 1.6 | 0.0 | 1.0 | 5.358042 | 1.0729e−16 | 1.00000 | B | 1.600000 | 0.033660 |
| YxxIHA | EecCCC | 1.5 | 0.0 | 1.0 | 6.463791 | 1.0843e−16 | 1.00000 | B | 1.500000 | 0.023375 |
| DxxRFV | CccCCE | 1.0 | 0.0 | 1.0 | 6.799182 | 1.0867e−16 | 1.00000 | B | 1.000000 | 0.021173 |

TABLE 23-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| TxxVFE | CccEEC | 1.0 | 0.0 | 1.0 | 9.900521 | 1.0990e−16 | 1.00000 | B | 1.000000 | 0.010099 |
| GxxDNG | CceEEE | 1.0 | 0.0 | 1.0 | 10.153886 | 1.0996e−16 | 1.00000 | B | 1.000000 | 0.009606 |
| DxxGNG | CccCCC | 30.0 | 4.5 | 174.5 | 12.117828 | 3.3659e−16 | 1.00000 | B | 0.171920 | 0.025984 |
| AxxVGK | CccCCH | 8.6 | 0.1 | 32.0 | 33.752156 | 1.0516e−15 | 1.00000 | B | 0.268750 | 0.002003 |
| PxxSGK | CccCCH | 11.0 | 0.2 | 54.7 | 21.809359 | 1.3203e−15 | 1.00000 | B | 0.201097 | 0.004466 |
| KxxFTV | HhcCCH | 11.1 | 0.4 | 14.1 | 17.687177 | 1.7765e−15 | 1.00000 | B | 0.787234 | 0.026782 |
| RxxTFK | HhcCCC | 11.0 | 0.5 | 11.5 | 15.520720 | 2.5051e−15 | 1.00000 | B | 0.956522 | 0.041692 |
| GxxKTS | CccHHH | 13.9 | 0.6 | 33.5 | 16.756306 | 2.7900e−15 | 1.00000 | B | 0.414925 | 0.019061 |
| QxxGKT | CccCHH | 10.2 | 0.2 | 23.0 | 21.950729 | 3.1726e−15 | 1.00000 | B | 0.443478 | 0.009090 |
| DxxTGK | CccCCH | 8.0 | 0.1 | 31.4 | 29.149732 | 8.1205e−15 | 1.00000 | B | 0.254777 | 0.002360 |
| LxxSGK | CccCCH | 9.0 | 0.1 | 31.2 | 24.222034 | 1.0197e−14 | 1.00000 | B | 0.288462 | 0.004312 |
| QxxGYG | CccCHH | 12.3 | 0.6 | 20.1 | 15.259162 | 4.3218e−14 | 1.00000 | B | 0.611940 | 0.030129 |
| MxxCTL | EecCCC | 7.0 | 0.1 | 9.0 | 26.919571 | 4.4228e−14 | 1.00000 | B | 0.777778 | 0.007425 |
| QxxSCW | CccCHH | 6.1 | 0.0 | 20.2 | 40.736633 | 6.6470e−14 | 1.00000 | B | 0.301980 | 0.001103 |
| MxxFKF | HccCCE | 7.5 | 0.1 | 10.7 | 26.539741 | 1.4215e−13 | 1.00000 | B | 0.700935 | 0.007362 |
| GxxKSA | CccHHH | 14.5 | 0.9 | 56.2 | 14.356408 | 1.4566e−13 | 1.00000 | B | 0.258007 | 0.016205 |
| LxxKDY | HhhCCC | 12.4 | 0.8 | 17.5 | 13.258420 | 4.4705e−13 | 1.00000 | B | 0.708571 | 0.045827 |
| RxxGIG | CccCCH | 10.2 | 0.4 | 15.1 | 15.563661 | 4.7518e−13 | 1.00000 | B | 0.675497 | 0.026947 |
| SxxACW | CceCHH | 5.2 | 0.0 | 4.0 | 67.545729 | 5.8875e−13 | 1.00000 | B | 1.300000 | 0.000876 |
| GxxIMS | CccHHH | 5.0 | 0.0 | 5.8 | 38.483793 | 9.0813e−13 | 1.00000 | B | 0.862069 | 0.002899 |
| CxxGVG | CccCCH | 5.8 | 0.0 | 18.8 | 42.983619 | 1.8140e−12 | 1.00000 | B | 0.308511 | 0.000963 |
| KxxACK | EeeCCC | 15.3 | 1.4 | 42.0 | 11.769566 | 3.0198e−12 | 1.00000 | B | 0.364286 | 0.034205 |
| GxxGKT | CccCCH | 16.5 | 1.7 | 115.5 | 11.634197 | 7.0138e−12 | 1.00000 | B | 0.142857 | 0.014306 |
| NxxSGK | CccCCH | 5.5 | 0.0 | 10.0 | 35.698627 | 9.1312e−12 | 1.00000 | B | 0.550000 | 0.002359 |
| QxxTGK | CccCCH | 7.5 | 0.1 | 16.1 | 20.225448 | 1.5596e−11 | 1.00000 | B | 0.465839 | 0.008308 |
| IxxYTP | EccCCC | 9.6 | 0.3 | 54.6 | 16.103991 | 2.2522e−11 | 1.00000 | B | 0.175824 | 0.006102 |
| NxxPNR | HhcHHH | 13.9 | 1.2 | 47.4 | 11.480225 | 3.1658e−11 | 1.00000 | B | 0.293249 | 0.026318 |
| MxxSRN | HhhHCC | 13.4 | 1.2 | 42.0 | 11.445113 | 4.7252e−11 | 1.00000 | B | 0.319048 | 0.027951 |
| NxxCKN | EecCCC | 13.3 | 1.2 | 43.0 | 11.287293 | 6.3736e−11 | 1.00000 | B | 0.309302 | 0.027552 |
| SxxAGN | EccCCC | 7.0 | 0.2 | 7.1 | 13.993809 | 6.7483e−11 | 1.00000 | B | 0.985915 | 0.034010 |
| AxxKTT | CccHHH | 9.0 | 0.4 | 21.5 | 13.833100 | 7.3110e−11 | 1.00000 | B | 0.418605 | 0.018337 |
| ExxVGK | CccCCH | 7.7 | 0.2 | 34.6 | 18.607804 | 9.4920e−11 | 1.00000 | B | 0.222543 | 0.004762 |
| VxxGCI | HhcCCH | 4.0 | 0.0 | 6.5 | 40.995245 | 1.0625e−10 | 1.00000 | B | 0.615385 | 0.001460 |
| CxxGIG | CccCCH | 4.5 | 0.0 | 12.4 | 45.567392 | 1.0818e−10 | 1.00000 | B | 0.362903 | 0.000784 |
| RxxPFN | EecCCC | 7.5 | 0.1 | 6.0 | 16.214277 | 1.2341e−10 | 1.00000 | B | 1.250000 | 0.022313 |
| SxxGKT | CccCHH | 14.0 | 1.4 | 83.3 | 10.619350 | 1.7092e−10 | 1.00000 | B | 0.168067 | 0.017123 |
| KxxACH | HccCCC | 7.0 | 0.1 | 6.0 | 15.752097 | 1.7322e−10 | 1.00000 | B | 1.166667 | 0.023610 |
| TxxGKS | CccCHH | 10.6 | 0.6 | 35.1 | 12.475499 | 2.4413e−10 | 1.00000 | B | 0.301994 | 0.018470 |
| LxxICR | CccCCH | 4.0 | 0.0 | 7.8 | 37.197058 | 2.9087e−10 | 1.00000 | B | 0.512821 | 0.001476 |
| SxxWPS | CccCCC | 19.8 | 5.3 | 162.2 | 6.396654 | 3.2879e−10 | 1.00000 | N | 0.122072 | 0.032719 |
| RxxLPE | HhhCCC | 11.6 | 0.9 | 30.6 | 11.271642 | 3.4023e−10 | 1.00000 | B | 0.379085 | 0.030226 |
| RxxGLG | CccCCH | 6.3 | 0.1 | 10.8 | 18.190253 | 4.2775e−10 | 1.00000 | B | 0.583333 | 0.010816 |
| KxxSPQ | HhcCCC | 5.2 | 0.1 | 7.1 | 21.929565 | 5.3759e−10 | 1.00000 | B | 0.732394 | 0.007812 |
| VxxGKT | CccCHH | 10.0 | 0.6 | 44.3 | 11.867670 | 5.9907e−10 | 1.00000 | B | 0.225734 | 0.014269 |
| DxxGGG | ChhHCC | 9.8 | 0.6 | 19.9 | 11.917268 | 6.6472e−10 | 1.00000 | B | 0.492462 | 0.030812 |
| PxxGKG | CccCHH | 11.0 | 0.9 | 38.6 | 10.839654 | 8.0255e−10 | 1.00000 | B | 0.284974 | 0.023067 |
| GxxLGR | CccHHH | 7.0 | 0.2 | 10.9 | 13.800966 | 8.0725e−10 | 1.00000 | B | 0.642202 | 0.022484 |
| LxxGMV | CeeEEE | 3.3 | 0.0 | 8.2 | 68.087959 | 9.9956e−10 | 1.00000 | B | 0.402439 | 0.000286 |
| LxxAGK | EccCCH | 7.0 | 0.2 | 13.5 | 13.633148 | 1.6346e−09 | 1.00000 | B | 0.518519 | 0.018502 |
| TxxGVH | CceEEEE | 5.3 | 0.0 | 4.5 | 26.658583 | 1.9226e−09 | 1.00000 | B | 1.177778 | 0.006292 |
| SxxSLS | EccEEE | 19.5 | 5.5 | 109.4 | 6.102942 | 1.9949e−09 | 1.00000 | N | 0.178245 | 0.050489 |
| TxxIGE | EecCCE | 6.3 | 0.2 | 6.3 | 13.360594 | 2.1393e−09 | 1.00000 | B | 1.000000 | 0.034090 |
| GxxGSC | CccCCH | 7.1 | 0.2 | 32.1 | 14.576219 | 2.1556e−09 | 1.00000 | B | 0.221184 | 0.006981 |
| GxxKSS | CccHHH | 10.2 | 0.8 | 37.0 | 10.871965 | 2.5245e−09 | 1.00000 | B | 0.275676 | 0.020771 |
| GxxKSC | CccCHH | 8.5 | 0.4 | 19.9 | 12.276595 | 2.8204e−09 | 1.00000 | B | 0.427136 | 0.022147 |
| CxxGGW | CccCHH | 3.0 | 0.0 | 10.9 | 55.906034 | 2.9320e−09 | 1.00000 | B | 0.275229 | 0.000264 |
| DxxDIG | CccCHH | 6.0 | 0.2 | 9.5 | 14.714780 | 2.9576e−09 | 1.00000 | B | 0.631579 | 0.016864 |
| AxxGDS | CccCCC | 10.8 | 0.8 | 106.3 | 11.008754 | 3.4357e−09 | 1.00000 | B | 0.101599 | 0.007781 |
| WxxGYA | CccCHH | 5.0 | 0.0 | 4.0 | 22.536110 | 3.7289e−09 | 1.00000 | B | 1.250000 | 0.007814 |
| KxxRME | CccCCC | 7.4 | 0.3 | 17.5 | 13.498147 | 3.7508e−09 | 1.00000 | B | 0.422857 | 0.016148 |
| QxxGIM | CccCHH | 4.8 | 0.0 | 7.0 | 25.824874 | 3.9991e−09 | 1.00000 | B | 0.685714 | 0.004889 |
| KxxHPY | HhhCCC | 6.5 | 0.3 | 6.6 | 12.654223 | 5.5331e−09 | 1.00000 | B | 0.984848 | 0.038395 |
| NxxCGS | CeeEEE | 5.5 | 0.1 | 5.0 | 14.589457 | 6.3685e−09 | 1.00000 | B | 1.100000 | 0.022951 |
| GxxHDI | CccCCH | 6.0 | 0.3 | 6.1 | 11.668890 | 6.4387e−09 | 1.00000 | B | 0.983607 | 0.041485 |
| GxxKTF | CccHHH | 8.0 | 0.5 | 17.8 | 11.183882 | 6.8420e−09 | 1.00000 | B | 0.449438 | 0.026180 |
| VxxLMV | EeeEEE | 3.0 | 0.0 | 4.0 | 42.629167 | 7.5384e−09 | 1.00000 | B | 0.750000 | 0.001236 |
| LxxFMR | EccCCC | 5.0 | 0.1 | 11.0 | 17.765741 | 7.6538e−09 | 1.00000 | B | 0.454545 | 0.007029 |
| KxxGLD | HhcCCC | 15.6 | 2.5 | 68.8 | 8.533480 | 8.1840e−09 | 1.00000 | B | 0.226744 | 0.035744 |
| GxxGFT | HhhCCH | 12.9 | 1.7 | 33.5 | 8.805582 | 8.4299e−09 | 1.00000 | B | 0.385075 | 0.050848 |

TABLE 24

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxGxxT | CcChhH | 95.5 | 16.6 | 530.8 | 19.647819 | 3.4828e-85 | 1.00000 | N | 0.179917 | 0.031337 |
| VxCxxG | EcCccC | 40.5 | 1.7 | 79.3 | 30.256305 | 1.7042e-45 | 1.00000 | B | 0.510719 | 0.021207 |
| ExIxxW | CcChhH | 22.8 | 0.2 | 24.5 | 51.610706 | 8.9399e-45 | 1.00000 | B | 0.930612 | 0.007893 |
| SxKxxK | CeEeeE | 64.0 | 14.8 | 237.7 | 13.179769 | 3.3609e-39 | 1.00000 | N | 0.269247 | 0.062429 |
| TxTxxT | CcCchH | 32.0 | 1.2 | 56.5 | 28.650551 | 7.1879e-39 | 1.00000 | B | 0.566372 | 0.020916 |
| GxSxxE | CcChhH | 92.3 | 27.3 | 563.9 | 12.762018 | 4.6873e-37 | 1.00000 | N | 0.163682 | 0.048374 |
| LxPxxR | CcHhhH | 39.9 | 7.4 | 228.2 | 12.087836 | 5.8061e-33 | 1.00000 | N | 0.174847 | 0.032646 |
| GxPxxQ | CcChhH | 38.5 | 7.2 | 136.1 | 11.993530 | 1.9062e-32 | 1.00000 | N | 0.282880 | 0.052856 |
| NxTxxE | CcChhH | 54.0 | 13.3 | 264.7 | 11.434346 | 7.0416e-30 | 1.00000 | N | 0.204005 | 0.050340 |
| GxTxxQ | CcChhH | 51.1 | 12.8 | 261.6 | 10.949601 | 1.6032e-27 | 1.00000 | N | 0.195336 | 0.049082 |
| RxIxxF | EeEccC | 32.0 | 3.0 | 66.9 | 16.977592 | 3.0617e-25 | 1.00000 | B | 0.478326 | 0.045546 |
| GxGxxS | CcChhH | 41.3 | 4.9 | 257.3 | 16.498267 | 3.7587e-25 | 1.00000 | B | 0.160513 | 0.019237 |
| PxWxxG | CeEccC | 14.5 | 0.2 | 18.7 | 32.157769 | 9.6205e-25 | 1.00000 | B | 0.775401 | 0.010689 |
| SxAxxR | ChHhhH | 47.9 | 13.4 | 257.1 | 9.692430 | 6.3584e-22 | 1.00000 | N | 0.186309 | 0.052044 |
| QxPxxL | EeCceE | 34.6 | 7.9 | 344.0 | 9.568532 | 3.0272e-21 | 1.00000 | N | 0.100581 | 0.023093 |
| DxAxxT | CcCchH | 22.1 | 1.4 | 57.2 | 17.870923 | 3.8331e-21 | 1.00000 | B | 0.386364 | 0.024086 |
| NxGxxT | CcChhH | 25.8 | 2.5 | 65.9 | 15.098624 | 1.3414e-19 | 1.00000 | B | 0.391502 | 0.037617 |
| LxExxI | CcHhhH | 31.2 | 7.4 | 297.3 | 8.889427 | 1.6173e-18 | 1.00000 | N | 0.104945 | 0.024787 |
| TxVxxE | EeEeeE | 70.3 | 26.3 | 562.7 | 8.776302 | 2.0407e-18 | 1.00000 | N | 0.124933 | 0.046795 |
| LxExxR | CcHhhH | 29.6 | 6.8 | 193.1 | 8.870479 | 2.0553e-18 | 1.00000 | N | 0.153288 | 0.035373 |
| DxGxxK | CcCccH | 25.6 | 2.6 | 108.4 | 14.333505 | 6.4194e-18 | 1.00000 | B | 0.236162 | 0.024277 |
| LxPxxQ | CcChhH | 26.4 | 5.8 | 169.7 | 8.748374 | 6.9214e-18 | 1.00000 | N | 0.155569 | 0.033949 |
| ExSxxE | CcChhH | 46.7 | 14.6 | 297.5 | 8.631726 | 9.6940e-18 | 1.00000 | N | 0.156975 | 0.048973 |
| YxSxxT | HhCccC | 20.3 | 1.6 | 51.4 | 14.976341 | 2.1046e-17 | 1.00000 | B | 0.394942 | 0.031285 |
| GxSxxN | CeChhH | 21.5 | 2.0 | 57.9 | 14.186410 | 6.8792e-17 | 1.00000 | B | 0.371330 | 0.033905 |
| SxTxxD | HcEeeE | 58.2 | 21.1 | 334.4 | 8.334126 | 1.0029e-16 | 1.00000 | N | 0.174042 | 0.063172 |
| RxDxxY | EeecC | 1.0 | 0.0 | 1.0 | 6.479049 | 1.0844e-16 | 1.00000 | B | 1.000000 | 0.023268 |
| GxSxxT | CcChhH | 25.9 | 5.9 | 139.5 | 8.404110 | 1.2643e-16 | 1.00000 | N | 0.185663 | 0.042356 |
| PxHxxL | CcHhhC | 12.9 | 0.5 | 18.3 | 18.181695 | 2.5192e-16 | 1.00000 | B | 0.704918 | 0.026188 |
| DxAxxQ | ChHhhH | 30.4 | 7.9 | 151.2 | 8.256938 | 3.4079e-16 | 1.00000 | N | 0.201058 | 0.051986 |
| TxCxxC | CcHhhH | 14.7 | 0.9 | 13.5 | 14.119043 | 5.4430e-16 | 1.00000 | B | 1.088889 | 0.063426 |
| GxSxxA | CcChhH | 30.1 | 7.8 | 260.9 | 8.142754 | 8.5659e-16 | 1.00000 | N | 0.115370 | 0.029738 |
| TxAxxE | ChHhhH | 42.1 | 13.3 | 254.5 | 8.093575 | 9.1094e-16 | 1.00000 | N | 0.165422 | 0.052386 |
| CxAxxG | CcCcH | 11.6 | 0.3 | 44.1 | 22.129643 | 9.5347e-16 | 1.00000 | B | 0.263039 | 0.005986 |
| GxDxxQ | CcChhH | 29.0 | 7.4 | 147.4 | 8.106973 | 1.1979e-15 | 1.00000 | N | 0.196744 | 0.050510 |
| SxYxxE | ChHhhH | 23.4 | 2.9 | 60.5 | 12.397158 | 1.2306e-15 | 1.00000 | B | 0.386777 | 0.047559 |
| CxNxxT | CcCccC | 21.3 | 2.3 | 79.4 | 12.866017 | 4.0656e-15 | 1.00000 | B | 0.268262 | 0.028403 |
| TxAxxK | ChHhhH | 33.7 | 9.7 | 179.1 | 7.910811 | 4.7461e-15 | 1.00000 | N | 0.188163 | 0.054259 |
| SxSxxA | CcChhH | 28.4 | 7.3 | 190.0 | 7.931919 | 4.8305e-15 | 1.00000 | N | 0.149474 | 0.038609 |
| CxGxxY | EeCccC | 16.0 | 1.2 | 54.7 | 13.787800 | 2.6979e-14 | 1.00000 | B | 0.292505 | 0.021585 |
| LxDxxR | CcHhhH | 24.5 | 6.0 | 159.0 | 7.656071 | 4.7140e-14 | 1.00000 | N | 0.154088 | 0.038000 |
| GxTxxD | CcChhH | 47.3 | 16.9 | 366.4 | 7.557245 | 5.3153e-14 | 1.00000 | N | 0.129094 | 0.046209 |
| LxSxxR | CcHhhH | 20.0 | 2.2 | 79.5 | 12.061536 | 5.7006e-14 | 1.00000 | B | 0.251572 | 0.028083 |
| NxKxxK | CeEeeE | 32.2 | 9.6 | 154.0 | 7.535957 | 8.5785e-14 | 1.00000 | N | 0.209091 | 0.062307 |
| GxGxxA | CcChhH | 24.7 | 6.2 | 337.1 | 7.548724 | 1.0269e-13 | 1.00000 | N | 0.073272 | 0.018245 |
| SxVxxS | CcCchH | 21.3 | 2.6 | 98.9 | 11.741540 | 1.0710e-13 | 1.00000 | B | 0.215369 | 0.026329 |
| LxExxK | CcHhhH | 24.2 | 6.0 | 184.2 | 7.523785 | 1.2703e-13 | 1.00000 | N | 0.131379 | 0.032735 |
| TxTxxE | CcChhH | 30.8 | 9.0 | 191.4 | 7.468604 | 1.4651e-13 | 1.00000 | N | 0.160920 | 0.046846 |
| SxGxxC | EeCccC | 15.5 | 1.0 | 147.6 | 14.198789 | 1.5326e-13 | 1.00000 | B | 0.105014 | 0.007073 |
| GxSxxD | CcChhH | 52.0 | 19.9 | 441.1 | 7.347550 | 2.3629e-13 | 1.00000 | N | 0.117887 | 0.045205 |
| GxSxxQ | CcChhH | 32.5 | 9.9 | 203.2 | 7.392465 | 2.4290e-13 | 1.00000 | N | 0.159941 | 0.048517 |
| FxVxxN | CcHhhH | 9.0 | 0.2 | 14.7 | 17.947861 | 3.1447e-13 | 1.00000 | B | 0.612245 | 0.016469 |
| DxAxxE | ChHhhH | 48.7 | 18.3 | 339.8 | 7.304968 | 3.3650e-13 | 1.00000 | N | 0.143320 | 0.053861 |
| FxTxxR | ChHhhH | 13.6 | 1.1 | 20.2 | 12.530961 | 6.0951e-13 | 1.00000 | B | 0.673267 | 0.052338 |
| SxExxR | ChHhhH | 62.2 | 26.5 | 481.7 | 7.130862 | 1.0256e-12 | 1.00000 | N | 0.129126 | 0.055033 |
| SxAxxE | ChHhhH | 40.7 | 14.4 | 301.5 | 7.112073 | 1.5082e-12 | 1.00000 | N | 0.134992 | 0.047697 |
| MxTxxF | HcCccE | 7.5 | 0.1 | 11.8 | 22.356778 | 2.0200e-12 | 1.00000 | B | 0.635593 | 0.009346 |
| RxSxxE | CeEhhH | 9.0 | 0.3 | 8.9 | 15.363457 | 2.1971e-12 | 1.00000 | B | 1.011236 | 0.036336 |
| TxAxxQ | ChHhhH | 35.1 | 11.8 | 204.9 | 6.994651 | 3.8335e-12 | 1.00000 | N | 0.171303 | 0.057525 |
| NxTxxH | HhChhH | 13.9 | 1.1 | 47.4 | 12.497161 | 5.0108e-12 | 1.00000 | B | 0.293249 | 0.022727 |
| NxSxxD | CcChhH | 25.1 | 7.0 | 145.6 | 6.979942 | 5.7351e-12 | 1.00000 | N | 0.172390 | 0.048331 |
| GxNxxE | CcChhH | 35.9 | 12.3 | 268.7 | 6.879201 | 8.2900e-12 | 1.00000 | N | 0.133606 | 0.045839 |
| LxAxxR | CcHhhH | 23.3 | 4.1 | 144.3 | 9.678385 | 1.6775e-11 | 1.00000 | B | 0.161469 | 0.028167 |
| FxGxxA | ChHhhH | 13.1 | 1.1 | 51.0 | 11.868621 | 2.5395e-11 | 1.00000 | B | 0.256864 | 0.020630 |
| QxRxxG | CcCchH | 11.8 | 0.9 | 20.3 | 11.983867 | 2.9355e-11 | 1.00000 | B | 0.581281 | 0.042817 |
| SxGxxR | CcCchH | 13.2 | 1.0 | 69.8 | 12.021912 | 2.9539e-11 | 1.00000 | B | 0.189112 | 0.014882 |
| ExDxxG | HhCccC | 20.8 | 5.4 | 144.5 | 6.752501 | 3.2182e-11 | 1.00000 | N | 0.143945 | 0.037384 |
| AxGxxT | CcChhH | 14.7 | 1.4 | 71.0 | 11.378940 | 3.7774e-11 | 1.00000 | B | 0.207042 | 0.019643 |
| DxAxxR | ChHhhH | 33.9 | 11.7 | 212.5 | 6.651301 | 3.9842e-11 | 1.00000 | N | 0.159529 | 0.055269 |
| GxDxxA | CcChhH | 41.7 | 16.0 | 346.5 | 6.586367 | 5.2939e-11 | 1.00000 | N | 0.120346 | 0.046127 |
| GxTxxE | CcChhH | 54.9 | 23.8 | 506.5 | 6.546520 | 5.9175e-11 | 1.00000 | N | 0.108391 | 0.046894 |
| TxSxxE | CcChhH | 26.4 | 8.1 | 188.8 | 6.578130 | 7.8469e-11 | 1.00000 | N | 0.139943 | 0.042863 |
| PxTxxQ | CcChhH | 21.7 | 5.9 | 173.7 | 6.591601 | 8.7031e-11 | 1.00000 | N | 0.124928 | 0.034126 |
| TxDxxR | CcHhhH | 16.8 | 2.3 | 45.8 | 9.817220 | 9.5154e-11 | 1.00000 | B | 0.366812 | 0.050164 |
| GxCxxC | CcCcH | 7.4 | 0.2 | 31.8 | 18.650457 | 9.8742e-11 | 1.00000 | B | 0.232704 | 0.004772 |
| SxAxxA | ChHhhH | 31.9 | 10.8 | 324.7 | 6.517178 | 9.9192e-11 | 1.00000 | N | 0.098245 | 0.033327 |
| AxGxxK | CcCccH | 15.1 | 1.7 | 77.9 | 10.453088 | 1.1289e-10 | 1.00000 | B | 0.193838 | 0.021614 |

TABLE 24-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| QxRxxE | CcChhH | 21.8 | 4.2 | 68.2 | 8.849948 | 1.4429e-10 | 1.00000 | B | 0.319648 | 0.061734 |
| GxDxxE | CcChhH | 36.8 | 13.7 | 254.3 | 6.426476 | 1.6131e-10 | 1.00000 | N | 0.144711 | 0.053792 |
| NxAxxK | ChHhhH | 23.7 | 7.1 | 137.1 | 6.437742 | 2.1271e-10 | 1.00000 | N | 0.172867 | 0.051429 |
| DxAxxD | ChHhhH | 28.7 | 9.5 | 168.1 | 6.409489 | 2.1528e-10 | 1.00000 | N | 0.170732 | 0.056547 |
| TxAxxR | ChHhhH | 26.0 | 8.1 | 178.9 | 6.402991 | 2.4282e-10 | 1.00000 | N | 0.145333 | 0.045534 |
| NxGxxK | CcCccH | 10.0 | 0.6 | 25.9 | 11.827359 | 3.0863e-10 | 1.00000 | B | 0.386100 | 0.024785 |
| DxAxxA | ChHhhH | 40.7 | 16.0 | 424.8 | 6.306170 | 3.2326e-10 | 1.00000 | N | 0.095810 | 0.037604 |
| NxGxxS | CcChhH | 15.0 | 1.9 | 51.5 | 9.590943 | 4.1423e-10 | 1.00000 | B | 0.291262 | 0.037466 |
| GxGxxI | EcCeeE | 12.5 | 1.1 | 47.7 | 10.879784 | 4.3984e-10 | 1.00000 | B | 0.262055 | 0.023487 |
| NxGxxV | ChHhhH | 10.2 | 0.6 | 56.2 | 12.284253 | 4.6883e-10 | 1.00000 | B | 0.181495 | 0.010952 |
| KxSxxE | CcChhH | 34.8 | 13.0 | 249.7 | 6.189193 | 7.3797e-10 | 1.00000 | N | 0.139367 | 0.052226 |
| CxGxxC | EcCccC | 7.5 | 0.2 | 22.1 | 15.600743 | 7.6434e-10 | 1.00000 | B | 0.339367 | 0.009952 |
| SxTxxE | CcChhH | 26.3 | 8.6 | 179.1 | 6.210132 | 7.9457e-10 | 1.00000 | N | 0.146845 | 0.047823 |
| TxGxxT | EeCceE | 20.6 | 5.9 | 114.1 | 6.222362 | 9.2284e-10 | 1.00000 | N | 0.180543 | 0.051636 |
| SxAxxQ | ChHhhH | 32.9 | 12.2 | 229.7 | 6.116524 | 1.1926e-09 | 1.00000 | N | 0.143233 | 0.052898 |
| NxAxxR | ChHhhH | 18.8 | 3.4 | 71.1 | 8.575669 | 1.4009e-09 | 1.00000 | B | 0.264416 | 0.047686 |
| RxRxxN | EeCccC | 11.5 | 1.1 | 29.6 | 10.340734 | 1.5733e-09 | 1.00000 | B | 0.388514 | 0.035728 |
| LxDxxK | CcHhhH | 18.8 | 3.3 | 105.3 | 8.623619 | 1.8769e-09 | 1.00000 | B | 0.178538 | 0.031578 |
| GxNxxQ | CcChhH | 20.6 | 4.1 | 96.7 | 8.325608 | 1.9155e-09 | 1.00000 | B | 0.213030 | 0.042410 |
| HxCxxH | CcCchH | 9.8 | 0.8 | 14.2 | 10.365943 | 2.3489e-09 | 1.00000 | B | 0.690141 | 0.056264 |
| FxHxxH | EcHhhH | 8.0 | 0.5 | 10.3 | 10.594488 | 2.7755e-09 | 1.00000 | B | 0.776699 | 0.050930 |
| NxFxxA | HcCchH | 7.3 | 0.3 | 12.0 | 12.967742 | 2.9756e-09 | 1.00000 | B | 0.608333 | 0.024910 |

TABLE 25

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| SxKxDK | CeEeEE | 56.6 | 10.6 | 226.5 | 14.510498 | 5.1077e-47 | 1.00000 | N | 0.249890 | 0.046621 |
| TxTxKT | CcCcHH | 27.3 | 0.4 | 35.1 | 41.402645 | 3.3263e-45 | 1.00000 | B | 0.777778 | 0.012151 |
| TxVxKK | EeEeEE | 68.9 | 17.0 | 371.5 | 12.858963 | 1.8898e-37 | 1.00000 | N | 0.185464 | 0.045880 |
| DxAxKT | CcCcHH | 21.3 | 0.3 | 36.1 | 42.228224 | 1.7463e-36 | 1.00000 | B | 0.590028 | 0.006931 |
| VxCxNG | EcCcCC | 27.6 | 1.3 | 56.3 | 22.965619 | 2.7459e-29 | 1.00000 | B | 0.490231 | 0.023790 |
| SxTxVD | HcEeEE | 57.7 | 15.5 | 332.4 | 10.970812 | 1.1028e-27 | 1.00000 | N | 0.173586 | 0.046666 |
| DxGxGK | CcCcCH | 23.6 | 0.8 | 90.6 | 25.557645 | 2.7107e-27 | 1.00000 | B | 0.260486 | 0.008861 |
| GxGxTT | CcChHH | 38.1 | 3.9 | 150.8 | 17.412946 | 2.6727e-26 | 1.00000 | B | 0.252653 | 0.026192 |
| GxGxST | CcChHH | 33.8 | 3.1 | 132.3 | 17.712534 | 5.1241e-25 | 1.00000 | B | 0.255480 | 0.023279 |
| SxGxGR | CcCcHH | 13.2 | 0.1 | 48.5 | 43.386267 | 6.4655e-25 | 1.00000 | B | 0.272165 | 0.001886 |
| SxTxNT | CcCcHH | 12.5 | 0.1 | 11.0 | 29.834372 | 8.9716e-22 | 1.00000 | B | 1.136364 | 0.012207 |
| NxKxDK | CeEeEE | 29.8 | 6.4 | 135.4 | 9.482096 | 8.5112e-21 | 1.00000 | N | 0.220089 | 0.047229 |
| QxPxSL | EeCcEE | 27.9 | 5.8 | 253.4 | 9.267533 | 6.6594e-20 | 1.00000 | N | 0.110103 | 0.022941 |
| YxSxRT | HhCcCC | 17.3 | 0.9 | 30.2 | 18.031141 | 3.4196e-19 | 1.00000 | B | 0.572848 | 0.028343 |
| CxGxIC | EcCcCC | 7.0 | 0.0 | 12.0 | 65.805632 | 5.1452e-19 | 1.00000 | B | 0.583333 | 0.000941 |
| SxVxKS | CcCcHH | 15.3 | 0.5 | 48.4 | 20.089608 | 3.7836e-18 | 1.00000 | B | 0.316116 | 0.011271 |
| NxGxTT | CcChHH | 15.8 | 0.7 | 25.1 | 17.983191 | 4.6058e-18 | 1.00000 | B | 0.629482 | 0.028833 |
| PxWxIG | CeEcCC | 12.3 | 0.1 | 9.3 | 27.308812 | 1.0008e-17 | 1.00000 | B | 1.322581 | 0.012317 |
| PxHxAL | CcHhHC | 11.0 | 0.3 | 13.1 | 20.593235 | 3.3394e-17 | 1.00000 | B | 0.839695 | 0.021144 |
| HxAxVA | EeEeCC | 3.0 | 0.0 | 1.0 | 4.880275 | 1.0655e-16 | 1.00000 | B | 3.000000 | 0.040295 |
| RxTxDD | EeEhHH | 1.5 | 0.0 | 1.0 | 5.879314 | 1.0790e-16 | 1.00000 | B | 1.500000 | 0.028114 |
| DxSxNT | CcEhHH | 1.0 | 0.0 | 1.0 | 6.087175 | 1.0810e-16 | 1.00000 | B | 1.000000 | 0.026279 |
| LxAxVK | ChHhHH | 1.0 | 0.0 | 1.0 | 6.162276 | 1.0817e-16 | 1.00000 | B | 1.000000 | 0.025658 |
| NxFxDS | HhHcCC | 1.0 | 0.0 | 1.0 | 6.660356 | 1.0857e-16 | 1.00000 | B | 1.000000 | 0.022046 |
| YxIxTG | EcCcCC | 1.0 | 0.0 | 1.0 | 7.772472 | 1.0921e-16 | 1.00000 | B | 1.000000 | 0.016284 |
| MxYxKI | CcEeCC | 1.5 | 0.0 | 1.0 | 8.569222 | 1.0953e-16 | 1.00000 | B | 1.500000 | 0.013435 |
| GxGxTS | CcChHH | 13.9 | 0.6 | 32.9 | 18.152055 | 3.8821e-16 | 1.00000 | B | 0.422492 | 0.016720 |
| PxGxGK | CcCcCH | 19.0 | 1.4 | 130.3 | 14.923143 | 4.2284e-16 | 1.00000 | B | 0.145817 | 0.010785 |
| KxVxCK | EeEcCC | 17.6 | 1.4 | 47.7 | 14.183369 | 3.3780e-15 | 1.00000 | B | 0.368973 | 0.028318 |
| AxGxGK | CcCcCH | 13.3 | 0.5 | 57.6 | 17.711953 | 4.1489e-15 | 1.00000 | B | 0.230903 | 0.009115 |
| CxAxIG | CcCcCC | 8.5 | 0.1 | 15.5 | 25.381903 | 2.8396e-14 | 1.00000 | B | 0.548387 | 0.007100 |
| LxNxGK | CcCcCH | 8.3 | 0.1 | 15.0 | 24.590088 | 4.0805e-14 | 1.00000 | B | 0.553333 | 0.007448 |
| SxGxGC | EeCcCC | 15.3 | 1.0 | 130.5 | 14.714935 | 5.5466e-14 | 1.00000 | B | 0.117241 | 0.007334 |
| NxGxGK | CcCcCH | 9.0 | 0.2 | 15.0 | 19.702967 | 6.8088e-14 | 1.00000 | B | 0.600000 | 0.013474 |
| SxGxGR | CcCcCH | 8.5 | 0.1 | 23.1 | 24.809324 | 8.9712e-14 | 1.00000 | B | 0.367965 | 0.004970 |
| LxNxCR | CcCcCH | 5.5 | 0.0 | 10.6 | 51.644952 | 2.5159e-13 | 1.00000 | B | 0.518868 | 0.001067 |
| QxGxCW | CcCcHH | 7.9 | 0.1 | 20.2 | 25.311731 | 4.5137e-13 | 1.00000 | B | 0.391089 | 0.004729 |
| CxAxVG | CcCcCH | 6.8 | 0.0 | 17.8 | 31.472647 | 1.0357e-12 | 1.00000 | B | 0.382022 | 0.002594 |
| LxGxGK | CcCcCH | 12.9 | 0.7 | 55.2 | 14.339566 | 1.0848e-12 | 1.00000 | B | 0.233696 | 0.013224 |
| NxTxNR | HhChHH | 13.8 | 1.0 | 47.4 | 13.035204 | 2.7237e-12 | 1.00000 | B | 0.291139 | 0.020818 |
| MxHxKF | HcCcCE | 7.5 | 0.1 | 11.8 | 20.657897 | 5.9295e-12 | 1.00000 | B | 0.635593 | 0.010909 |
| QxSxKT | CcCcHH | 7.2 | 0.1 | 17.7 | 21.756070 | 6.1332e-12 | 1.00000 | B | 0.406780 | 0.006042 |
| AxRxNF | CcCcCE | 7.3 | 0.1 | 18.3 | 21.494990 | 8.0040e-12 | 1.00000 | B | 0.398907 | 0.006148 |
| QxGxGK | CcCcCH | 11.5 | 0.6 | 50.9 | 14.221165 | 8.7531e-12 | 1.00000 | B | 0.225933 | 0.011689 |
| TxNxGE | EeCcCE | 7.5 | 0.2 | 7.5 | 15.735409 | 2.9385e-11 | 1.00000 | B | 1.000000 | 0.029400 |
| IxNxTP | EcCcCC | 9.6 | 0.3 | 51.6 | 15.771712 | 3.0578e-11 | 1.00000 | B | 0.186047 | 0.006716 |

TABLE 25-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| CxAxIG | CcCcCH | 4.8 | 0.0 | 9.7 | 49.375090 | 3.2308e−11 | 1.00000 | B | 0.494845 | 0.000971 |
| TxCxVH | CcEeEE | 5.3 | 0.0 | 7.0 | 29.062670 | 3.3981e−11 | 1.00000 | B | 0.757143 | 0.004714 |
| YxDxFQ | CcCcCC | 6.8 | 0.1 | 16.8 | 23.103835 | 3.7298e−11 | 1.00000 | B | 0.404762 | 0.005054 |
| AxNxRV | CcChHH | 8.3 | 0.1 | 6.4 | 18.908717 | 4.2509e−11 | 1.00000 | B | 1.296875 | 0.017585 |
| GxGxSA | CcChHH | 14.5 | 1.5 | 84.5 | 10.890707 | 1.2556e−10 | 1.00000 | B | 0.171598 | 0.017267 |
| AxGxTT | CcChHH | 9.0 | 0.4 | 22.7 | 13.379300 | 1.3988e−10 | 1.00000 | B | 0.396476 | 0.018462 |
| SxGxCW | CcEcHH | 5.7 | 0.0 | 11.5 | 27.137424 | 1.4181e−10 | 1.00000 | B | 0.495652 | 0.003792 |
| RxRxFN | EeCcCC | 7.5 | 0.1 | 6.0 | 15.932390 | 1.5159e−10 | 1.00000 | B | 1.250000 | 0.023091 |
| QxSxGA | CcCcEC | 5.2 | 0.1 | 5.0 | 21.291482 | 1.5452e−10 | 1.00000 | B | 1.040000 | 0.010909 |
| MxLxTL | EeCcCC | 7.0 | 0.2 | 11.1 | 15.638597 | 1.6234e−10 | 1.00000 | B | 0.630631 | 0.017371 |
| TxSxKT | CcCcHH | 10.5 | 0.6 | 48.6 | 12.982231 | 1.7709e−10 | 1.00000 | B | 0.216049 | 0.012137 |
| DxHxIG | CcCcHH | 6.0 | 0.1 | 7.3 | 17.182429 | 2.0446e−10 | 1.00000 | B | 0.821918 | 0.016313 |
| NxQxQF | CcCcCE | 10.1 | 0.6 | 29.2 | 11.908196 | 3.6689e−10 | 1.00000 | B | 0.345890 | 0.022079 |
| LxVxMV | CeEeEE | 3.3 | 0.0 | 9.0 | 78.494593 | 4.4384e−10 | 1.00000 | B | 0.366667 | 0.000196 |
| QxQxIM | CcCcHH | 4.8 | 0.0 | 5.0 | 31.368999 | 4.7125e−10 | 1.00000 | B | 0.960000 | 0.004659 |
| RxVxYT | EeCcCC | 9.1 | 0.5 | 23.1 | 12.387539 | 5.4387e−10 | 1.00000 | B | 0.393939 | 0.021353 |
| HxDxGK | CcCcCH | 8.0 | 0.3 | 38.9 | 13.707911 | 9.2865e−10 | 1.00000 | B | 0.205656 | 0.008142 |
| GxGxGR | CcChHH | 8.0 | 0.4 | 11.6 | 11.785433 | 1.0014e−09 | 1.00000 | B | 0.689655 | 0.036945 |
| WxHxYA | CcCcHH | 5.0 | 0.0 | 4.0 | 24.146704 | 2.1553e−09 | 1.00000 | B | 1.250000 | 0.006814 |
| WxNxFT | HhHcCC | 5.9 | 0.1 | 9.1 | 18.284331 | 2.4343e−09 | 1.00000 | B | 0.648352 | 0.011176 |
| FxExLT | HhHhHH | 14.2 | 1.8 | 105.3 | 9.392605 | 2.8537e−09 | 1.00000 | B | 0.134853 | 0.016894 |
| NxFxVA | HcCcHH | 6.3 | 0.2 | 8.0 | 14.231463 | 3.2657e−09 | 1.00000 | B | 0.787500 | 0.023607 |
| GxTxKT | CcCcHH | 8.0 | 0.4 | 32.0 | 12.304709 | 3.7481e−09 | 1.00000 | B | 0.250000 | 0.012108 |
| GxGxSS | CcChHH | 10.7 | 0.9 | 51.2 | 10.727384 | 4.1924e−09 | 1.00000 | B | 0.208984 | 0.016726 |
| VxWxRG | EeEcCC | 4.6 | 0.0 | 5.3 | 24.562668 | 5.3187e−09 | 1.00000 | B | 0.867925 | 0.006561 |
| ExGxSK | EcCcCE | 12.8 | 1.5 | 47.4 | 9.353019 | 5.8809e−09 | 1.00000 | B | 0.270042 | 0.031772 |
| SxGxGK | CcCcCH | 8.6 | 0.5 | 34.6 | 12.115751 | 6.1620e−09 | 1.00000 | B | 0.248555 | 0.013228 |
| QxRxYG | CcCcHH | 6.8 | 0.2 | 9.1 | 13.511358 | 6.4034e−09 | 1.00000 | B | 0.747253 | 0.026595 |
| TxPxVY | EcCeEE | 8.3 | 0.4 | 243.9 | 12.511059 | 7.2393e−09 | 1.00000 | B | 0.034030 | 0.001638 |
| VxHxKT | CcCcHH | 6.5 | 0.2 | 27.7 | 15.523646 | 7.7837e−09 | 1.00000 | B | 0.234657 | 0.006044 |
| YxFxLH | CcEeEE | 4.0 | 0.0 | 4.0 | 20.532673 | 7.8032e−09 | 1.00000 | B | 1.000000 | 0.009399 |
| DxRxTG | EeEcCC | 13.2 | 1.7 | 50.0 | 8.897809 | 8.4666e−09 | 1.00000 | B | 0.264000 | 0.034462 |
| GxVxKS | CcCcHH | 9.1 | 0.6 | 60.0 | 10.783366 | 1.1852e−08 | 1.00000 | B | 0.151667 | 0.010405 |
| AxTxKS | CcCcHH | 4.0 | 0.0 | 5.5 | 21.215041 | 1.4941e−08 | 1.00000 | B | 0.727273 | 0.006391 |
| GxCxSC | CcCcCH | 4.6 | 0.0 | 29.3 | 25.245739 | 1.5299e−08 | 1.00000 | B | 0.156997 | 0.001118 |
| GxGxSI | EcCeEE | 5.5 | 0.1 | 7.2 | 15.694859 | 1.5981e−08 | 1.00000 | B | 0.763889 | 0.016598 |
| KxYxME | CcCcCC | 8.4 | 0.5 | 19.0 | 10.767521 | 1.6629e−08 | 1.00000 | B | 0.442105 | 0.028822 |
| ExCxLG | EcCcCC | 5.0 | 0.1 | 5.8 | 13.975310 | 1.9806e−08 | 1.00000 | B | 0.862069 | 0.021445 |
| DxGxTT | CcChHH | 9.6 | 0.8 | 37.4 | 10.287614 | 1.9873e−08 | 1.00000 | B | 0.256684 | 0.020174 |
| NxAxKN | EeCcCC | 13.3 | 1.9 | 44.0 | 8.403028 | 2.1730e−08 | 1.00000 | B | 0.302273 | 0.043597 |
| SxVxKT | EeEeEE | 11.0 | 1.3 | 38.0 | 8.833970 | 2.7438e−08 | 1.00000 | B | 0.289474 | 0.033101 |
| GxGxSC | CcChHH | 8.5 | 0.6 | 21.8 | 10.479758 | 2.9812e−08 | 1.00000 | B | 0.389908 | 0.026882 |
| RxGxGR | CcChHH | 7.5 | 0.4 | 12.0 | 10.790353 | 3.2673e−08 | 1.00000 | B | 0.625000 | 0.037003 |
| GxTxEK | CeEeEE | 13.1 | 2.0 | 43.0 | 8.118745 | 3.5492e−08 | 1.00000 | B | 0.304651 | 0.045807 |
| GxSxET | CcChHH | 11.7 | 1.4 | 40.7 | 8.739976 | 4.0137e−08 | 1.00000 | B | 0.287469 | 0.035156 |
| GxGxSN | CcChHH | 6.3 | 0.2 | 15.3 | 12.729469 | 4.2660e−08 | 1.00000 | B | 0.411765 | 0.015085 |
| SxSxKS | CcCcHH | 7.7 | 0.4 | 27.8 | 11.446286 | 4.3518e−08 | 1.00000 | B | 0.276978 | 0.014804 |
| LxPxEF | CcChHH | 7.0 | 0.4 | 10.5 | 10.018015 | 4.4979e−08 | 1.00000 | B | 0.666667 | 0.042563 |
| IxGxSA | HhCcHH | 5.0 | 0.2 | 5.0 | 11.874412 | 4.7104e−08 | 1.00000 | B | 1.000000 | 0.034246 |
| GxDxYR | CcCcEC | 14.6 | 2.5 | 56.5 | 7.900639 | 5.0007e−08 | 1.00000 | B | 0.258407 | 0.043651 |
| QxRxLG | CcCcHH | 5.0 | 0.1 | 8.0 | 13.885421 | 5.0566e−08 | 1.00000 | B | 0.625000 | 0.015651 |
| VxFxFP | CcCcCC | 8.6 | 0.7 | 16.0 | 9.682042 | 5.1444e−08 | 1.00000 | B | 0.537500 | 0.043541 |
| NxFxGS | CcEeEC | 5.5 | 0.2 | 5.0 | 11.627430 | 5.7697e−08 | 1.00000 | B | 1.100000 | 0.035664 |

TABLE 26

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GxGKxT | CcCHhH | 78.2 | 4.7 | 290.1 | 34.047316 | 1.1506e−69 | 1.00000 | B | 0.269562 | 0.016316 |
| SxKVxK | CeEEeE | 59.8 | 11.1 | 226.5 | 14.982640 | 4.7717e−50 | 1.00000 | N | 0.264012 | 0.049037 |
| TxTGxT | CcCChH | 31.0 | 0.7 | 40.9 | 36.555165 | 1.3620e−46 | 1.00000 | B | 0.757946 | 0.017091 |
| VxCKxG | EcCCcC | 37.2 | 1.7 | 58.6 | 27.646791 | 3.2831e−42 | 1.00000 | B | 0.634812 | 0.028979 |
| DxAGxT | CcCChH | 21.3 | 0.2 | 35.9 | 45.944381 | 5.1346e−38 | 1.00000 | B | 0.593315 | 0.005903 |
| TxVDxE | EeEEeE | 69.3 | 18.1 | 368.2 | 12.323075 | 1.5043e−34 | 1.00000 | N | 0.188213 | 0.049248 |
| NxGKxT | CcCHhH | 23.8 | 0.7 | 46.8 | 27.221369 | 5.7232e−30 | 1.00000 | B | 0.508547 | 0.015591 |
| GxGKxS | CcCHhH | 23.6 | 0.7 | 72.6 | 26.546387 | 2.5060e−28 | 1.00000 | B | 0.325069 | 0.010313 |
| SxTKxD | HcEeeE | 56.0 | 15.5 | 313.0 | 10.555618 | 9.5006e−26 | 1.00000 | N | 0.178914 | 0.049499 |
| FxGHxA | CcCHhH | 10.6 | 0.1 | 13.0 | 40.140334 | 2.0626e−21 | 1.00000 | B | 0.815385 | 0.005323 |
| CxAGxG | CcCCcH | 10.3 | 0.1 | 39.0 | 42.746343 | 2.0803e−21 | 1.00000 | B | 0.264103 | 0.001474 |
| AxGKxT | CcCHhH | 14.4 | 0.3 | 36.4 | 25.127009 | 3.3324e−20 | 1.00000 | B | 0.395604 | 0.008706 |
| DxGVxK | CcCCcH | 15.1 | 0.4 | 50.9 | 23.714451 | 3.6388e−20 | 1.00000 | B | 0.296660 | 0.007620 |
| NxKVxK | CeEEeE | 30.8 | 6.9 | 138.8 | 9.289826 | 4.7236e−20 | 1.00000 | N | 0.221902 | 0.050018 |
| PxWNxG | CeECcC | 13.5 | 0.1 | 10.5 | 30.708828 | 4.8231e−20 | 1.00000 | B | 1.285714 | 0.011012 |

TABLE 26-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| YxSGxT | HhCCcC | 18.3 | 0.9 | 32.0 | 18.088408 | 6.9501e-20 | 1.00000 | B | 0.571875 | 0.029635 |
| CxNGxT | CcCCcC | 19.0 | 1.2 | 51.6 | 16.572407 | 2.1832e-18 | 1.00000 | B | 0.368217 | 0.022926 |
| SxVGxS | CcCChH | 15.3 | 0.6 | 42.3 | 19.232519 | 8.8090e-18 | 1.00000 | B | 0.361702 | 0.014021 |
| TxDDxQ | EhHHhH | 1.0 | 0.0 | 1.0 | 5.392626 | 1.0733e-16 | 1.00000 | B | 1.000000 | 0.033244 |
| CxGNxC | EcCCcC | 7.5 | 0.0 | 17.1 | 48.331529 | 1.0735e-16 | 1.00000 | B | 0.438596 | 0.001401 |
| AxKLxP | EeCCcC | 1.7 | 0.0 | 1.0 | 5.966017 | 1.0799e-16 | 1.00000 | B | 1.700000 | 0.027327 |
| FxISxI | HcCCcE | 1.8 | 0.0 | 1.0 | 5.996760 | 1.0802e-16 | 1.00000 | B | 1.800000 | 0.027055 |
| MxYIxI | CcEEcC | 1.5 | 0.0 | 1.0 | 7.242638 | 1.0895e-16 | 1.00000 | B | 1.500000 | 0.018707 |
| YxKIxA | EeCCcC | 1.5 | 0.0 | 1.0 | 7.671739 | 1.0917e-16 | 1.00000 | B | 1.500000 | 0.016707 |
| SxTGxT | CcCChH | 14.5 | 0.7 | 35.5 | 17.037291 | 7.8231e-16 | 1.00000 | B | 0.408451 | 0.018915 |
| SxGVxR | CcCChH | 7.3 | 0.0 | 19.1 | 37.942945 | 3.5076e-15 | 1.00000 | B | 0.382199 | 0.001922 |
| GxGKxA | CcCHhH | 15.5 | 0.8 | 83.3 | 16.034987 | 4.2733e-15 | 1.00000 | B | 0.186074 | 0.010132 |
| MxLCxL | EeCCcC | 7.0 | 0.0 | 9.1 | 31.828768 | 4.5925e-15 | 1.00000 | B | 0.769231 | 0.005270 |
| GxGFxI | EcCEeE | 8.2 | 0.1 | 10.9 | 24.137133 | 1.5684e-14 | 1.00000 | B | 0.752294 | 0.010406 |
| PxGSxK | CcCCcH | 11.0 | 0.4 | 37.7 | 17.974037 | 4.3376e-14 | 1.00000 | B | 0.291777 | 0.009394 |
| VxWGxG | EeECcC | 15.8 | 1.1 | 116.6 | 14.134376 | 1.1466e-13 | 1.00000 | B | 0.135506 | 0.009373 |
| SxGIxR | CcCChH | 5.9 | 0.0 | 20.2 | 52.593321 | 1.5200e-13 | 1.00000 | B | 0.292079 | 0.000621 |
| MxTFxF | HcCCcE | 7.5 | 0.1 | 10.7 | 26.233866 | 1.6674e-13 | 1.00000 | B | 0.700935 | 0.007532 |
| LxNAxK | CcCCcH | 6.3 | 0.0 | 10.5 | 34.674409 | 2.0201e-13 | 1.00000 | B | 0.600000 | 0.003121 |
| QxRGxG | CcCChH | 11.8 | 0.6 | 17.1 | 14.463365 | 3.4044e-13 | 1.00000 | B | 0.690058 | 0.036257 |
| SxGIxR | CcCCcH | 7.5 | 0.1 | 16.7 | 25.614984 | 6.6714e-13 | 1.00000 | B | 0.449102 | 0.005044 |
| NxACxN | EeCCcC | 14.3 | 1.1 | 43.0 | 12.984350 | 9.3387e-13 | 1.00000 | B | 0.332558 | 0.024775 |
| NxTPxL | CcCCcC | 11.8 | 0.6 | 39.8 | 14.917012 | 1.9147e-12 | 1.00000 | B | 0.296482 | 0.014437 |
| NxTPxR | HhCHhH | 13.9 | 1.0 | 46.4 | 12.909302 | 2.3592e-12 | 1.00000 | B | 0.299569 | 0.021942 |
| DxDGxG | CcCCcC | 35.9 | 11.9 | 416.7 | 7.054973 | 2.4585e-12 | 1.00000 | N | 0.086153 | 0.028573 |
| DxGTxK | CcCCcH | 8.0 | 0.2 | 31.0 | 18.449093 | 9.3255e-12 | 1.00000 | B | 0.258065 | 0.005829 |
| SxGAxW | CcEChH | 5.2 | 0.0 | 5.0 | 26.461826 | 1.7914e-11 | 1.00000 | B | 1.040000 | 0.007090 |
| SxYQxE | ChHHhH | 14.9 | 1.6 | 34.9 | 10.894015 | 1.9565e-11 | 1.00000 | B | 0.426934 | 0.044931 |
| KxYRxE | CcCCcC | 11.8 | 0.8 | 21.3 | 12.330460 | 1.9943e-11 | 1.00000 | B | 0.553991 | 0.038696 |
| QxKGxG | CcCChH | 10.0 | 0.6 | 14.0 | 12.292249 | 2.1041e-11 | 1.00000 | B | 0.714286 | 0.043579 |
| GxSIxG | CeEEeE | 9.5 | 0.3 | 35.1 | 15.756244 | 2.2978e-11 | 1.00000 | B | 0.270655 | 0.009721 |
| AxGVxK | CcCCcH | 7.6 | 0.1 | 32.6 | 20.714517 | 2.3926e-11 | 1.00000 | B | 0.233129 | 0.004005 |
| QxGTxK | CcCCcH | 7.5 | 0.1 | 16.6 | 19.297999 | 3.0906e-11 | 1.00000 | B | 0.451807 | 0.008825 |
| GxGIxS | CcCChH | 9.9 | 0.4 | 25.9 | 14.435885 | 3.2374e-11 | 1.00000 | B | 0.382239 | 0.016875 |
| FxVAxN | CcHHhH | 7.8 | 0.2 | 10.5 | 17.204917 | 3.4705e-11 | 1.00000 | B | 0.742857 | 0.018948 |
| SxKPxY | CcCCcC | 12.3 | 1.0 | 23.8 | 11.403495 | 4.1050e-11 | 1.00000 | B | 0.516807 | 0.042941 |
| SxSGxS | CcCChH | 7.7 | 0.2 | 22.4 | 18.639391 | 6.4291e-11 | 1.00000 | B | 0.343750 | 0.007350 |
| CxAGxG | CcCCcC | 8.3 | 0.3 | 28.1 | 16.106786 | 8.0611e-11 | 1.00000 | B | 0.295374 | 0.008965 |
| QxSGxT | CcCCcH | 7.2 | 0.2 | 19.1 | 17.864972 | 9.7007e-11 | 1.00000 | B | 0.376963 | 0.008205 |
| GxGKxF | CcCHhH | 9.0 | 0.4 | 20.6 | 12.995440 | 1.8542e-10 | 1.00000 | B | 0.436893 | 0.021509 |
| LxGAxK | CcCCcH | 6.5 | 0.1 | 16.9 | 20.766526 | 1.8659e-10 | 1.00000 | B | 0.384615 | 0.005660 |
| KxQSxQ | HhCCcC | 5.2 | 0.0 | 7.1 | 23.500158 | 2.7200e-10 | 1.00000 | B | 0.732394 | 0.006815 |
| DxPExL | EhHHhH | 12.7 | 1.2 | 38.0 | 10.917952 | 2.7228e-10 | 1.00000 | B | 0.334211 | 0.030355 |
| GxCGxC | CcCCcH | 7.4 | 0.2 | 31.3 | 17.167182 | 2.9306e-10 | 1.00000 | B | 0.236422 | 0.005687 |
| VxHGxT | CcCChH | 6.5 | 0.1 | 27.3 | 20.643805 | 2.9544e-10 | 1.00000 | B | 0.238095 | 0.003537 |
| GxGKxN | CcCHhH | 6.3 | 0.1 | 19.0 | 19.922337 | 3.2745e-10 | 1.00000 | B | 0.331579 | 0.005128 |
| NxGRxV | ChHHhH | 7.3 | 0.2 | 22.1 | 16.537083 | 3.4130e-10 | 1.00000 | B | 0.330317 | 0.008444 |
| FxTMxR | ChHHhH | 9.5 | 0.5 | 17.4 | 12.380879 | 3.5175e-10 | 1.00000 | B | 0.545977 | 0.031061 |
| KxVAxK | EeECcC | 15.3 | 2.0 | 42.0 | 9.504713 | 4.1563e-10 | 1.00000 | B | 0.364286 | 0.048679 |
| LxNIxR | CcCCcH | 4.0 | 0.0 | 7.8 | 34.838623 | 4.8974e-10 | 1.00000 | B | 0.512821 | 0.001682 |
| DxRExG | EeEEcC | 14.2 | 1.7 | 48.0 | 9.784977 | 5.8536e-10 | 1.00000 | B | 0.295833 | 0.035279 |
| DxQAxC | HhHHhH | 12.0 | 1.1 | 49.1 | 10.414659 | 8.3369e-10 | 1.00000 | B | 0.244399 | 0.022756 |
| NxGSxK | CcCCcH | 4.0 | 0.0 | 4.6 | 28.935098 | 8.3475e-10 | 1.00000 | B | 0.869565 | 0.004132 |
| RxVNxT | EeCCcC | 9.1 | 0.5 | 26.4 | 12.189591 | 8.6890e-10 | 1.00000 | B | 0.344697 | 0.019193 |
| NxRGxS | CeCCcC | 15.2 | 2.1 | 44.0 | 9.190897 | 9.0030e-10 | 1.00000 | B | 0.345455 | 0.048322 |
| RxQGxG | CcCChH | 7.7 | 0.3 | 8.6 | 12.844513 | 9.3322e-10 | 1.00000 | B | 0.895349 | 0.039740 |
| QxQGxG | CcCChH | 7.0 | 0.3 | 9.8 | 13.041557 | 1.1860e-09 | 1.00000 | B | 0.714286 | 0.027924 |
| DxGKxT | CcCHhH | 10.5 | 0.7 | 46.5 | 11.532441 | 1.2908e-09 | 1.00000 | B | 0.225806 | 0.015683 |
| GxTGxT | CcCChH | 8.2 | 0.3 | 36.7 | 13.463242 | 1.3489e-09 | 1.00000 | B | 0.223433 | 0.009366 |
| NxGKxS | CcChhH | 8.0 | 0.4 | 16.1 | 12.288612 | 1.4453e-09 | 1.00000 | B | 0.496894 | 0.024397 |
| IxGSxK | CcCCcH | 4.0 | 0.0 | 6.0 | 28.717832 | 1.5897e-09 | 1.00000 | B | 0.666667 | 0.003213 |
| PxSLxV | CcEEeE | 19.5 | 3.5 | 165.5 | 8.628967 | 1.9034e-09 | 1.00000 | B | 0.117825 | 0.021201 |
| SxVExT | EeEEeE | 12.4 | 1.4 | 30.8 | 9.647297 | 2.1655e-09 | 1.00000 | B | 0.402597 | 0.044428 |
| GxGYxT | CcCChH | 7.5 | 0.3 | 11.7 | 13.194752 | 2.3128e-09 | 1.00000 | B | 0.641026 | 0.026093 |
| TxCGxH | CcEEeE | 5.3 | 0.0 | 4.0 | 23.792462 | 2.4238e-09 | 1.00000 | B | 1.325000 | 0.007017 |
| RxRPxN | EeCCcC | 8.5 | 0.5 | 19.0 | 12.095644 | 3.2320e-09 | 1.00000 | B | 0.447368 | 0.023862 |
| VxGYxT | CcChhH | 6.0 | 0.2 | 6.1 | 12.352805 | 3.3436e-09 | 1.00000 | B | 0.983607 | 0.037190 |
| RxTGxS | EeCCcC | 12.3 | 1.3 | 50.0 | 9.683731 | 3.9672e-09 | 1.00000 | B | 0.246000 | 0.026408 |
| GxGKxC | CcCHhH | 8.5 | 0.5 | 23.7 | 12.085767 | 4.5202e-09 | 1.00000 | B | 0.358650 | 0.019074 |
| KxKAxH | HcCCcC | 5.0 | 0.1 | 5.0 | 14.665940 | 6.0513e-09 | 1.00000 | B | 1.000000 | 0.022718 |
| DxHDxG | CcCChH | 6.0 | 0.2 | 10.8 | 13.860542 | 7.7869e-09 | 1.00000 | B | 0.555556 | 0.016605 |
| QxGSxW | CcCChH | 6.1 | 0.2 | 24.7 | 15.059254 | 8.6876e-09 | 1.00000 | B | 0.246964 | 0.006346 |
| CxGGxM | HhCCcH | 8.0 | 0.4 | 26.4 | 11.415826 | 8.9656e-09 | 1.00000 | B | 0.303030 | 0.016873 |
| NxFCxS | CcEEcC | 5.5 | 0.1 | 5.0 | 13.483966 | 1.3733e-08 | 1.00000 | B | 1.100000 | 0.026764 |
| KxSQxK | EeCCcC | 6.0 | 0.0 | 4.0 | 18.700567 | 1.6355e-08 | 1.00000 | B | 1.500000 | 0.011309 |
| TxNIxE | EeCCcE | 6.3 | 0.3 | 6.3 | 11.104803 | 1.7890e-08 | 1.00000 | B | 1.000000 | 0.048605 |
| NxFTxA | HcCChH | 6.3 | 0.2 | 8.6 | 12.485050 | 1.8314e-08 | 1.00000 | B | 0.732558 | 0.028168 |

TABLE 26-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ExGGxW | CcCCcE | 6.5 | 0.2 | 13.3 | 13.527432 | 1.8754e−08 | 1.00000 | B | 0.488722 | 0.016480 |
| TxAQxE | ChHHhH | 10.1 | 1.0 | 32.5 | 9.403815 | 2.1503e−08 | 1.00000 | B | 0.310769 | 0.029888 |
| TxVFxN | EeEEcC | 5.4 | 0.1 | 11.2 | 16.298617 | 2.3107e−08 | 1.00000 | B | 0.482143 | 0.009509 |
| RxDTxQ | HhCCcC | 5.5 | 0.1 | 5.2 | 13.252766 | 2.4042e−08 | 1.00000 | B | 1.057692 | 0.028755 |
| DxEGxP | HhHCcC | 15.1 | 2.6 | 55.1 | 7.886866 | 2.6898e−08 | 1.00000 | B | 0.274047 | 0.047668 |
| GxGFxL | EcCEeE | 4.3 | 0.0 | 5.9 | 20.203205 | 3.1103e−08 | 1.00000 | B | 0.728814 | 0.007577 |
| FxYSxD | CcCCcC | 5.9 | 0.2 | 8.0 | 13.568243 | 3.5331e−08 | 1.00000 | B | 0.737500 | 0.022718 |

TABLE 27

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| SxKVDK | CeEEEE | 55.6 | 9.0 | 226.6 | 15.848462 | 1.0626e−55 | 1.00000 | N | 0.245366 | 0.039728 |
| TxVDKK | EeEEEE | 68.9 | 14.4 | 363.1 | 14.631509 | 6.3100e−48 | 1.00000 | N | 0.189755 | 0.039746 |
| TxTGKT | CcCCHH | 27.3 | 0.4 | 34.1 | 41.712557 | 1.1510e−45 | 1.00000 | B | 0.800587 | 0.012329 |
| DxAGKT | CcCCHH | 21.3 | 0.1 | 35.9 | 67.148907 | 7.5094e−45 | 1.00000 | B | 0.593315 | 0.002784 |
| GxGKTT | CcCHHH | 37.1 | 1.7 | 139.7 | 27.458764 | 2.4284e−38 | 1.00000 | B | 0.265569 | 0.012053 |
| SxTKVD | HcEEEE | 55.5 | 12.5 | 313.0 | 12.416336 | 6.4044e−35 | 1.00000 | N | 0.177316 | 0.039921 |
| GxGKST | CcCHHH | 30.9 | 1.2 | 106.0 | 27.358680 | 4.2728e−34 | 1.00000 | B | 0.291509 | 0.011250 |
| VxCKNG | EcCCCC | 26.6 | 1.4 | 55.2 | 21.380843 | 4.0094e−27 | 1.00000 | B | 0.481884 | 0.025784 |
| NxKVDK | CeEEEE | 29.8 | 5.5 | 135.3 | 10.625194 | 1.1533e−25 | 1.00000 | N | 0.220251 | 0.040399 |
| NxGKTT | CcCHHH | 15.8 | 0.3 | 24.1 | 29.281293 | 3.1531e−24 | 1.00000 | B | 0.655602 | 0.011790 |
| DxGVGK | CcCCCH | 15.1 | 0.2 | 50.6 | 32.811283 | 3.2521e−24 | 1.00000 | B | 0.298419 | 0.004088 |
| SxTGNT | CcCCHH | 12.5 | 0.1 | 11.0 | 29.987850 | 8.0249e−22 | 1.00000 | B | 1.136364 | 0.012084 |
| SxVGKS | CcCCHH | 15.3 | 0.3 | 41.7 | 26.658271 | 8.7346e−22 | 1.00000 | B | 0.366906 | 0.007632 |
| CxGNIC | EcCCCC | 7.0 | 0.0 | 12.0 | 95.810125 | 2.7036e−21 | 1.00000 | B | 0.583333 | 0.000444 |
| GxGKTS | CcCHHH | 13.9 | 0.2 | 31.5 | 28.626452 | 4.2468e−21 | 1.00000 | B | 0.441270 | 0.007293 |
| SxGIGR | CcCCCH | 7.5 | 0.0 | 14.7 | 93.158277 | 8.5854e−21 | 1.00000 | B | 0.510204 | 0.000440 |
| YxSGRT | HhCCCC | 17.3 | 0.7 | 30.2 | 19.573147 | 2.6454e−20 | 1.00000 | B | 0.572848 | 0.024310 |
| SxGVGR | CcCCHH | 7.3 | 0.0 | 18.1 | 67.069455 | 1.1733e−18 | 1.00000 | B | 0.403315 | 0.000653 |
| PxWNIG | CeECCC | 12.3 | 0.1 | 9.3 | 27.472358 | 9.0000e−18 | 1.00000 | B | 1.322581 | 0.012172 |
| GxDVVG | CcCHHH | 2.0 | 0.0 | 2.0 | 8.888636 | 1.0693e−17 | 1.00000 | B | 1.000000 | 0.024689 |
| GxGKSA | CcCHHH | 14.5 | 0.5 | 50.8 | 20.582995 | 1.4756e−17 | 1.00000 | B | 0.285433 | 0.009233 |
| PxGSGK | CcCCCH | 11.0 | 0.2 | 35.4 | 25.572158 | 2.5256e−17 | 1.00000 | B | 0.310734 | 0.005083 |
| CxAGIG | CcCCCC | 6.3 | 0.0 | 11.9 | 74.862067 | 2.6570e−17 | 1.00000 | B | 0.529412 | 0.000594 |
| HxASVA | EeEECC | 3.0 | 0.0 | 1.0 | 5.165831 | 1.0701e−16 | 1.00000 | B | 3.000000 | 0.036120 |
| AxKGLV | HhHCCC | 1.0 | 0.0 | 1.0 | 6.244247 | 1.0825e−16 | 1.00000 | B | 1.000000 | 0.025006 |
| YxKIHA | EeCCCC | 1.5 | 0.0 | 1.0 | 7.610023 | 1.0914e−16 | 1.00000 | B | 1.500000 | 0.016974 |
| RxTTLD | EeEEEE | 1.0 | 0.0 | 1.0 | 7.954816 | 1.0930e−16 | 1.00000 | B | 1.000000 | 0.015557 |
| MxYIKI | CcEECC | 1.5 | 0.0 | 1.0 | 8.335733 | 1.0945e−16 | 1.00000 | B | 1.500000 | 0.014188 |
| LxARVK | ChHHHH | 1.0 | 0.0 | 1.0 | 8.511831 | 1.0951e−16 | 1.00000 | B | 1.000000 | 0.013614 |
| RxLFLE | CcCHHH | 1.0 | 0.0 | 1.0 | 9.594150 | 1.0983e−16 | 1.00000 | B | 1.000000 | 0.010747 |
| GxRDNG | CcEEEE | 1.0 | 0.0 | 1.0 | 10.319729 | 1.0999e−16 | 1.00000 | B | 1.000000 | 0.009303 |
| LxNAGK | CcCCCH | 6.3 | 0.0 | 10.5 | 61.321730 | 2.2405e−16 | 1.00000 | B | 0.600000 | 0.001003 |
| DxGTGK | CcCCCH | 8.0 | 0.1 | 29.0 | 35.088156 | 4.0490e−16 | 1.00000 | B | 0.275862 | 0.001773 |
| SxGIGR | CcCCHH | 5.9 | 0.0 | 20.2 | 84.110847 | 1.3990e−15 | 1.00000 | B | 0.292079 | 0.000243 |
| AxGKTT | CcCCHH | 9.0 | 0.1 | 21.6 | 23.820242 | 7.2402e−15 | 1.00000 | B | 0.416667 | 0.006448 |
| MxLCTL | EeCCCC | 7.0 | 0.1 | 9.1 | 26.549827 | 5.6450e−14 | 1.00000 | B | 0.769231 | 0.007547 |
| KxVACK | EeECCC | 15.3 | 1.2 | 42.0 | 13.180952 | 1.8560e−13 | 1.00000 | B | 0.364286 | 0.028111 |
| QxSGKT | CcCCHH | 7.2 | 0.1 | 17.0 | 26.686569 | 3.5476e−13 | 1.00000 | B | 0.423529 | 0.004215 |
| QxGSCW | CcCCHH | 6.1 | 0.0 | 20.2 | 34.553496 | 4.6995e−13 | 1.00000 | B | 0.301980 | 0.001530 |
| SxSGKS | CcCCHH | 7.7 | 0.1 | 21.4 | 26.468945 | 5.2265e−13 | 1.00000 | B | 0.359813 | 0.003885 |
| MxTFKF | HcCCCE | 7.5 | 0.1 | 10.7 | 24.027808 | 5.5753e−13 | 1.00000 | B | 0.700935 | 0.008955 |
| GxTGKT | CcCCHH | 8.0 | 0.1 | 30.9 | 22.029457 | 6.1861e−13 | 1.00000 | B | 0.258900 | 0.004149 |
| GxGIMS | CcCHHH | 5.0 | 0.0 | 5.0 | 36.561607 | 7.1860e−13 | 1.00000 | B | 1.000000 | 0.003726 |
| NxTPNR | HhCHHH | 13.8 | 1.0 | 46.4 | 13.288369 | 1.7188e−12 | 1.00000 | B | 0.297434 | 0.020563 |
| VxHGKT | CcCCHH | 6.5 | 0.0 | 27.3 | 30.546954 | 3.0058e−12 | 1.00000 | B | 0.238095 | 0.001638 |
| CxAGVG | CcCCCH | 5.8 | 0.0 | 17.8 | 40.693813 | 3.0166e−12 | 1.00000 | B | 0.325843 | 0.001135 |
| AxGVGK | CcCCCH | 7.6 | 0.1 | 31.0 | 23.748136 | 3.6395e−12 | 1.00000 | B | 0.245161 | 0.003228 |
| SxGACW | CcECHH | 5.2 | 0.0 | 4.0 | 53.110192 | 4.0212e−12 | 1.00000 | B | 1.300000 | 0.001416 |
| AxNGDS | CcCCCC | 5.0 | 0.0 | 6.0 | 33.087901 | 4.6504e−12 | 1.00000 | B | 0.833333 | 0.003786 |
| DxGKTT | CcCHHH | 9.5 | 0.3 | 35.5 | 17.343265 | 4.7098e−12 | 1.00000 | B | 0.267606 | 0.008017 |
| LxNICR | CcCCCH | 4.0 | 0.0 | 7.8 | 61.829719 | 5.0603e−12 | 1.00000 | B | 0.512821 | 0.000536 |
| CxAGIG | CcCCCH | 4.5 | 0.0 | 9.7 | 64.816014 | 5.4850e−12 | 1.00000 | B | 0.463918 | 0.000496 |
| GxGKSS | CcCHHH | 9.7 | 0.3 | 34.0 | 16.497208 | 9.1680e−12 | 1.00000 | B | 0.285294 | 0.009588 |
| IxNYTP | EcCCCC | 9.6 | 0.3 | 47.0 | 16.379090 | 1.5314e−11 | 1.00000 | B | 0.204255 | 0.006873 |
| NxACKN | EeCCCC | 13.3 | 1.1 | 43.0 | 11.980088 | 1.8020e−11 | 1.00000 | B | 0.309302 | 0.024858 |
| NxGSGK | CcCCCH | 4.0 | 0.0 | 4.0 | 42.938701 | 2.1963e−11 | 1.00000 | B | 1.000000 | 0.002165 |
| QxGTGK | CcCCCH | 7.5 | 0.1 | 16.1 | 19.678453 | 2.2578e−11 | 1.00000 | B | 0.465839 | 0.008763 |
| LxVGMV | CeEEEE | 3.3 | 0.0 | 7.0 | 117.793861 | 3.4484e−11 | 1.00000 | B | 0.471429 | 0.000112 |
| YxDNFQ | CcCCCC | 6.8 | 0.1 | 15.8 | 22.244783 | 5.4167e−11 | 1.00000 | B | 0.430380 | 0.005790 |
| TxCGVH | CcEEEE | 5.3 | 0.0 | 4.0 | 36.267536 | 8.4493e−11 | 1.00000 | B | 1.325000 | 0.003032 |
| GxGKSN | CcCHHH | 6.3 | 0.1 | 13.0 | 21.117590 | 1.0495e−10 | 1.00000 | B | 0.484615 | 0.006703 |

TABLE 27-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| DxHDIG | CcCCHH | 6.0 | 0.1 | 6.8 | 17.457699 | 1.1976e-10 | 1.00000 | B | 0.882353 | 0.016997 |
| RxRPFN | EeCCCC | 7.5 | 0.1 | 6.0 | 16.071908 | 1.3686e-10 | 1.00000 | B | 1.250000 | 0.022701 |
| NxSGKS | CcCCHH | 5.0 | 0.0 | 13.1 | 25.781208 | 2.4284e-10 | 1.00000 | B | 0.381679 | 0.002837 |
| GxGKSC | CcCHHH | 8.5 | 0.3 | 19.8 | 14.494190 | 2.4906e-10 | 1.00000 | B | 0.429293 | 0.016339 |
| LxGAGK | CcCCCH | 6.5 | 0.1 | 15.9 | 19.909508 | 2.8421e-10 | 1.00000 | B | 0.408805 | 0.006534 |
| TxSGKT | CcCCHH | 10.5 | 0.6 | 48.6 | 12.584345 | 3.0343e-10 | 1.00000 | B | 0.216049 | 0.012838 |
| RxVNYT | EeCCCC | 9.1 | 0.5 | 22.1 | 12.656039 | 3.5603e-10 | 1.00000 | B | 0.411765 | 0.021478 |
| GxVGKS | CcCCHH | 9.1 | 0.4 | 55.2 | 13.436593 | 3.7410e-10 | 1.00000 | B | 0.164855 | 0.007617 |
| TxNIGE | EeCCCE | 6.3 | 0.2 | 6.3 | 14.647106 | 7.3598e-10 | 1.00000 | B | 1.000000 | 0.028528 |
| PxVGKS | CcCCHH | 7.5 | 0.2 | 26.5 | 15.812094 | 7.6266e-10 | 1.00000 | B | 0.283019 | 0.008077 |
| KxYRME | CcCCCC | 7.4 | 0.2 | 16.0 | 15.025400 | 8.0890e-10 | 1.00000 | B | 0.462500 | 0.014437 |
| GxGLGR | CcCHHH | 7.0 | 0.1 | 5.0 | 17.703901 | 9.5454e-10 | 1.00000 | B | 1.400000 | 0.015702 |
| QxQGIM | CcCCHH | 4.8 | 0.0 | 5.0 | 28.122826 | 1.1237e-09 | 1.00000 | B | 0.960000 | 0.005790 |
| KxQSPQ | HhCCCC | 5.2 | 0.1 | 7.1 | 20.111796 | 1.2579e-09 | 1.00000 | B | 0.732394 | 0.009265 |
| QxRGYG | CcCCHH | 6.8 | 0.2 | 9.1 | 15.336532 | 1.4944e-09 | 1.00000 | B | 0.747253 | 0.020849 |
| NxGKST | CcCHHH | 8.0 | 0.4 | 22.7 | 12.520330 | 2.0100e-09 | 1.00000 | B | 0.352423 | 0.016606 |
| GxGKTF | CcCHHH | 8.0 | 0.4 | 17.8 | 12.110334 | 2.1948e-09 | 1.00000 | B | 0.449438 | 0.022622 |
| SxVGKT | CcCCHH | 6.0 | 0.1 | 21.0 | 16.640878 | 2.2754e-09 | 1.00000 | B | 0.285714 | 0.005970 |
| NxFCGS | CcEEEC | 5.5 | 0.1 | 5.0 | 15.478503 | 3.5703e-09 | 1.00000 | B | 1.100000 | 0.020443 |
| NxFTVA | HcCCHH | 6.3 | 0.2 | 8.1 | 14.131219 | 3.6966e-09 | 1.00000 | B | 0.777778 | 0.023628 |
| GxTVEK | CeEEEE | 13.1 | 1.6 | 41.1 | 9.138482 | 3.7062e-09 | 1.00000 | B | 0.318735 | 0.039863 |
| WxHGYA | CcCCHH | 5.0 | 0.0 | 4.0 | 22.521458 | 3.7482e-09 | 1.00000 | B | 1.250000 | 0.007824 |
| KxKACH | HcCCCC | 5.0 | 0.1 | 5.0 | 14.885519 | 5.2330e-09 | 1.00000 | B | 1.000000 | 0.022067 |
| KxSQQK | EeCCCC | 6.0 | 0.0 | 4.0 | 20.959247 | 6.6296e-09 | 1.00000 | B | 1.500000 | 0.009023 |
| ExTFPD | CcCCCC | 8.6 | 0.6 | 14.0 | 10.957842 | 6.6646e-09 | 1.00000 | B | 0.614286 | 0.040051 |
| VxFTFP | CcCCCC | 8.6 | 0.6 | 14.0 | 10.948237 | 6.7483e-09 | 1.00000 | B | 0.614286 | 0.040115 |
| VxWGRG | EeECCC | 4.6 | 0.0 | 5.3 | 23.040320 | 8.8272e-09 | 1.00000 | B | 0.867925 | 0.007448 |
| GxGYAT | CcCHHH | 5.0 | 0.0 | 4.0 | 20.181971 | 8.9445e-09 | 1.00000 | B | 1.250000 | 0.009725 |
| IxGSGK | CcCCCH | 4.0 | 0.0 | 6.0 | 22.389604 | 1.1417e-08 | 1.00000 | B | 0.666667 | 0.005264 |
| DxRETG | EeEECC | 12.2 | 1.5 | 48.0 | 8.975496 | 1.4213e-08 | 1.00000 | B | 0.254167 | 0.030697 |
| GxGKGT | CcCHHH | 10.2 | 1.0 | 37.7 | 9.601553 | 1.9441e-08 | 1.00000 | B | 0.270557 | 0.025246 |
| SxGAGK | CcCCCH | 4.6 | 0.0 | 7.0 | 21.675509 | 2.2554e-08 | 1.00000 | B | 0.657143 | 0.006351 |
| VxGYGT | CcCHHH | 5.8 | 0.2 | 6.1 | 13.788700 | 2.4146e-08 | 1.00000 | B | 0.950820 | 0.028106 |
| SxKPLY | CcCCCC | 8.6 | 0.7 | 16.0 | 10.023813 | 3.1924e-08 | 1.00000 | B | 0.537500 | 0.040940 |
| HxDHGK | CcCCCH | 5.0 | 0.1 | 33.0 | 16.457663 | 3.2287e-08 | 1.00000 | B | 0.151515 | 0.002705 |
| QxRGLG | CcCCHH | 5.0 | 0.1 | 7.0 | 14.024044 | 3.4288e-08 | 1.00000 | B | 0.714286 | 0.017585 |
| GxGFSI | EcCEEE | 4.0 | 0.1 | 4.4 | 17.653767 | 3.6548e-08 | 1.00000 | B | 0.909091 | 0.011507 |
| IxGNSA | HhCCHH | 5.0 | 0.2 | 5.0 | 12.190063 | 3.6553e-08 | 1.00000 | B | 1.000000 | 0.032553 |

TABLE 28

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GLxxxQ | CCchhH | 54.6 | 10.0 | 239.5 | 14.376318 | 3.6957e-46 | 1.00000 | N | 0.227975 | 0.041884 |
| EVxxxW | CCchhH | 23.1 | 0.5 | 25.5 | 31.732726 | 8.9916e-37 | 1.00000 | B | 0.905882 | 0.020272 |
| GIxxxQ | CCchhH | 44.1 | 8.5 | 170.0 | 12.547464 | 1.8680e-35 | 1.00000 | N | 0.259412 | 0.049891 |
| STxxxK | CEeeeE | 68.0 | 18.7 | 273.9 | 11.805445 | 7.5425e-32 | 1.00000 | N | 0.248266 | 0.068310 |
| LSxxxH | HHhhhH | 34.7 | 6.5 | 227.6 | 11.162649 | 2.8341e-28 | 1.00000 | N | 0.152460 | 0.028772 |
| GSxxxT | CCchhH | 36.4 | 3.6 | 141.4 | 17.566235 | 8.1592e-26 | 1.00000 | B | 0.257426 | 0.025327 |
| NPxxxE | CCchhH | 30.1 | 5.6 | 135.5 | 10.539187 | 2.7481e-25 | 1.00000 | N | 0.222140 | 0.041521 |
| GLxxxE | CCchhH | 55.6 | 15.7 | 370.9 | 10.286605 | 1.5314e-24 | 1.00000 | N | 0.149906 | 0.042345 |
| TQxxxT | CCcchH | 18.0 | 0.7 | 24.5 | 21.679320 | 1.1385e-23 | 1.00000 | B | 0.734694 | 0.026840 |
| GFxxxD | CCchhH | 35.3 | 7.7 | 175.1 | 10.141682 | 1.1664e-23 | 1.00000 | N | 0.201599 | 0.044152 |
| GGxxxN | CCchhH | 27.3 | 5.1 | 106.7 | 10.105386 | 2.5924e-23 | 1.00000 | N | 0.255858 | 0.047587 |
| CSxxxG | CCcccH | 11.6 | 0.1 | 36.9 | 42.938111 | 5.1216e-22 | 1.00000 | B | 0.314363 | 0.001957 |
| VAxxxG | ECcchH | 36.9 | 5.0 | 129.3 | 14.592371 | 8.2210e-22 | 1.00000 | B | 0.285383 | 0.038494 |
| LPxxxR | CChhhH | 31.2 | 6.7 | 201.9 | 9.644138 | 1.7359e-21 | 1.00000 | N | 0.154532 | 0.033103 |
| SLxxxE | CCchhH | 36.6 | 9.3 | 220.9 | 9.134791 | 1.5180e-19 | 1.00000 | N | 0.165686 | 0.042167 |
| GVxxxE | CCchhH | 38.3 | 10.2 | 238.7 | 8.992735 | 5.1079e-19 | 1.00000 | N | 0.160452 | 0.042731 |
| KExxxA | CCchhH | 25.3 | 5.2 | 85.5 | 9.049696 | 5.5135e-19 | 1.00000 | N | 0.295904 | 0.061241 |
| CKxxxT | CCcccC | 29.6 | 3.7 | 96.1 | 13.675704 | 1.2906e-18 | 1.00000 | B | 0.308012 | 0.038755 |
| LSxxxQ | CChhhH | 25.1 | 5.2 | 186.8 | 8.904430 | 1.9586e-18 | 1.00000 | N | 0.134368 | 0.027613 |
| TGxxxT | CCcchH | 26.5 | 5.8 | 112.2 | 8.834358 | 3.3175e-18 | 1.00000 | N | 0.236185 | 0.051631 |
| LSxxxR | CChhhH | 40.4 | 11.5 | 293.2 | 8.662063 | 8.5519e-18 | 1.00000 | N | 0.137790 | 0.039389 |
| DLxxxE | CChhhH | 30.3 | 7.4 | 187.5 | 8.615766 | 1.7599e-17 | 1.00000 | N | 0.161600 | 0.039316 |
| FSxxxY | HHcccH | 1.1 | 0.1 | 1.0 | 4.074728 | 1.0472e-16 | 1.00000 | B | 1.100000 | 0.056807 |
| NMxxxE | CCchhH | 27.0 | 3.8 | 79.7 | 12.253842 | 1.9659e-16 | 1.00000 | B | 0.338770 | 0.047324 |
| LTxxxR | CChhhH | 30.4 | 7.8 | 203.9 | 8.238198 | 3.9476e-16 | 1.00000 | N | 0.149093 | 0.038329 |
| YAxxxT | HHcccC | 20.8 | 2.0 | 55.2 | 13.691929 | 4.2721e-16 | 1.00000 | B | 0.376812 | 0.035555 |
| LTxxxK | CChhhH | 29.4 | 7.5 | 198.1 | 8.183120 | 6.3961e-16 | 1.00000 | N | 0.148410 | 0.037688 |
| QSxxxL | EEcceE | 30.2 | 7.8 | 260.2 | 8.169296 | 6.9027e-16 | 1.00000 | N | 0.116065 | 0.029863 |
| ERxxxD | HHhheC | 16.2 | 1.0 | 36.2 | 15.054070 | 8.6591e-16 | 1.00000 | B | 0.447514 | 0.028832 |
| LDxxxR | CChhhH | 32.5 | 8.9 | 240.5 | 8.068869 | 1.4172e-15 | 1.00000 | N | 0.135135 | 0.036966 |

TABLE 28-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| TKxxxC | CChhhH | 11.0 | 0.5 | 12.0 | 14.531388 | 1.8514e−14 | 1.00000 | B | 0.916667 | 0.045202 |
| CExxxY | EEcccC | 17.7 | 1.5 | 50.9 | 13.362872 | 2.0202e−14 | 1.00000 | B | 0.347741 | 0.029713 |
| SWxxxC | EEcccC | 15.5 | 0.9 | 140.2 | 15.144607 | 2.9263e−14 | 1.00000 | B | 0.110556 | 0.006644 |
| SAxxxR | CHhhhH | 38.1 | 12.2 | 224.6 | 7.644138 | 3.2710e−14 | 1.00000 | N | 0.169635 | 0.054175 |
| VQxxxS | ECcccC | 25.7 | 6.6 | 164.8 | 7.619327 | 5.8468e−14 | 1.00000 | N | 0.155947 | 0.039850 |
| NLxxxD | CChhhH | 24.9 | 6.2 | 242.5 | 7.619062 | 6.0600e−14 | 1.00000 | N | 0.102680 | 0.025522 |
| ELxxxE | CChhhH | 27.3 | 7.3 | 172.9 | 7.544366 | 9.5073e−14 | 1.00000 | N | 0.157895 | 0.042349 |
| GVxxxA | CChhhH | 27.9 | 4.8 | 176.5 | 10.653267 | 1.3946e−13 | 1.00000 | B | 0.158074 | 0.027331 |
| YHxxxE | HHhhhH | 23.2 | 5.7 | 128.6 | 7.516035 | 1.4229e−13 | 1.00000 | N | 0.180404 | 0.044191 |
| TVxxxE | CHhhhH | 24.2 | 6.2 | 110.1 | 7.404460 | 3.0474e−13 | 1.00000 | N | 0.219800 | 0.056658 |
| SAxxxR | CCcchH | 16.6 | 1.4 | 68.1 | 12.837428 | 3.2464e−13 | 1.00000 | B | 0.243759 | 0.020953 |
| PTxxxG | CEeccC | 16.5 | 1.4 | 85.8 | 12.894317 | 4.0322e−13 | 1.00000 | B | 0.192308 | 0.016258 |
| QTxxxK | CCcccH | 14.2 | 1.0 | 50.3 | 13.307139 | 6.6972e−13 | 1.00000 | B | 0.282306 | 0.019950 |
| TKxxxK | EEeeeE | 67.0 | 29.5 | 480.9 | 7.130159 | 9.9543e−13 | 1.00000 | N | 0.139322 | 0.061317 |
| GAxxxT | CChhhH | 26.4 | 4.7 | 165.8 | 10.161537 | 1.2729e−12 | 1.00000 | B | 0.159228 | 0.028319 |
| LSxxxK | CChhhH | 29.4 | 8.7 | 241.0 | 7.163028 | 1.3727e−12 | 1.00000 | N | 0.121992 | 0.036016 |
| GYxxxN | CEchhH | 14.0 | 1.1 | 42.3 | 12.536419 | 1.6774e−12 | 1.00000 | B | 0.330969 | 0.025738 |
| NTxxxK | CEeeeE | 33.8 | 11.0 | 168.6 | 7.116682 | 1.6931e−12 | 1.00000 | N | 0.200474 | 0.065182 |
| DNxxxP | CChhhH | 5.3 | 0.0 | 5.0 | 32.897939 | 2.0566e−12 | 1.00000 | B | 1.060000 | 0.004599 |
| WLxxxH | HHcccC | 15.4 | 1.4 | 51.8 | 12.142070 | 2.2839e−12 | 1.00000 | B | 0.297297 | 0.026471 |
| RAxxxR | HHhhhH | 62.9 | 27.3 | 536.8 | 6.997202 | 2.6193e−12 | 1.00000 | N | 0.117176 | 0.050836 |
| EAxxxE | HHhhhH | 84.2 | 40.9 | 815.1 | 6.937320 | 3.5127e−12 | 1.00000 | N | 0.103300 | 0.050228 |
| GLxxxI | ECceeE | 9.7 | 0.4 | 17.7 | 15.497102 | 8.0689e−12 | 1.00000 | B | 0.548023 | 0.020915 |
| ACxxxS | CCcccC | 19.1 | 2.5 | 123.5 | 10.614314 | 8.2065e−12 | 1.00000 | B | 0.154656 | 0.020220 |
| GVxxxD | CChhhH | 23.4 | 6.3 | 189.3 | 6.927950 | 8.7577e−12 | 1.00000 | N | 0.123613 | 0.033287 |
| LSxxxI | CChhhH | 25.4 | 7.1 | 404.3 | 6.907684 | 9.1681e−12 | 1.00000 | N | 0.062825 | 0.017623 |
| QTxxxK | HHhhhH | 25.6 | 7.4 | 144.0 | 6.832254 | 1.5255e−11 | 1.00000 | N | 0.177778 | 0.051705 |
| SSxxxD | HCeeeE | 41.2 | 15.6 | 216.6 | 6.724105 | 2.1591e−11 | 1.00000 | N | 0.190212 | 0.072065 |
| GVxxxQ | CCehhH | 10.9 | 0.6 | 9.5 | 11.942747 | 2.4637e−11 | 1.00000 | B | 1.147368 | 0.062447 |
| NAxxxQ | HHhhhH | 20.6 | 5.3 | 129.5 | 6.788754 | 2.5681e−11 | 1.00000 | N | 0.159073 | 0.040908 |
| CHxxxR | HHhhhC | 11.0 | 0.9 | 14.0 | 10.896171 | 2.8578e−11 | 1.00000 | B | 0.785714 | 0.065457 |
| GVxxxS | CChhH | 21.8 | 3.7 | 118.3 | 9.593989 | 3.8268e−11 | 1.00000 | B | 0.184277 | 0.031117 |
| GRxxxE | CChhhH | 25.7 | 7.7 | 147.8 | 6.680390 | 4.1501e−11 | 1.00000 | N | 0.173884 | 0.051943 |
| PGxxxL | CChhhC | 18.3 | 2.5 | 95.4 | 10.049115 | 5.2259e−11 | 1.00000 | B | 0.191824 | 0.026518 |
| SAxxxK | CHhhhH | 30.0 | 9.9 | 163.6 | 6.620898 | 5.3547e−11 | 1.00000 | N | 0.183374 | 0.060226 |
| AAxxxT | CChhhH | 14.1 | 1.4 | 47.8 | 10.751572 | 7.3154e−11 | 1.00000 | B | 0.294979 | 0.029943 |
| FPxxxT | HHhhhH | 22.4 | 4.2 | 81.3 | 9.076903 | 7.4347e−11 | 1.00000 | B | 0.275523 | 0.052004 |
| RExxxR | HHhhhH | 94.3 | 50.1 | 805.4 | 6.456703 | 8.6412e−11 | 1.00000 | N | 0.117085 | 0.062155 |
| HLxxxH | CCcchH | 10.0 | 0.6 | 18.2 | 12.034072 | 9.4334e−11 | 1.00000 | B | 0.549451 | 0.034515 |
| EFxxxD | EEchhH | 6.7 | 0.1 | 18.7 | 21.811739 | 1.0142e−10 | 1.00000 | B | 0.358289 | 0.004932 |
| SGxxxD | EEeccE | 50.1 | 21.4 | 292.4 | 6.445800 | 1.1982e−10 | 1.00000 | N | 0.171341 | 0.073174 |
| FTxxxN | CChhhH | 10.0 | 0.6 | 19.8 | 12.030980 | 1.2267e−10 | 1.00000 | B | 0.505051 | 0.031658 |
| RIxxxQ | CChhhH | 14.1 | 1.5 | 60.7 | 10.622272 | 1.3315e−10 | 1.00000 | B | 0.232290 | 0.023928 |
| QCxxxH | HHhhhH | 13.0 | 1.3 | 29.3 | 10.304706 | 1.5452e−10 | 1.00000 | B | 0.443686 | 0.045783 |
| GFxxxG | CEeeeE | 11.7 | 0.8 | 72.6 | 12.120611 | 2.1618e−10 | 1.00000 | B | 0.161157 | 0.011234 |
| CLxxxC | ECcccC | 6.5 | 0.1 | 11.0 | 19.364662 | 2.2273e−10 | 1.00000 | B | 0.590909 | 0.009999 |
| TCxxxH | HHhhhH | 10.8 | 0.7 | 27.1 | 11.927434 | 2.8064e−10 | 1.00000 | B | 0.398524 | 0.027021 |
| TAxxxE | CHhhhH | 29.1 | 9.8 | 179.3 | 6.350328 | 3.0867e−10 | 1.00000 | N | 0.162298 | 0.054574 |
| PTxxxL | CChhhH | 23.0 | 6.7 | 322.9 | 6.377182 | 3.1697e−10 | 1.00000 | N | 0.071229 | 0.020700 |
| LDxxxK | ECcccH | 8.5 | 0.4 | 15.3 | 13.692060 | 3.4070e−10 | 1.00000 | B | 0.555556 | 0.023649 |
| AExxxV | HHhhcC | 21.2 | 3.9 | 171.0 | 8.898036 | 3.9391e−10 | 1.00000 | B | 0.123977 | 0.022677 |
| KCxxxH | HCcccC | 10.6 | 0.8 | 22.5 | 11.558959 | 4.2767e−10 | 1.00000 | B | 0.471111 | 0.033381 |
| LHxxxL | HHhhcC | 15.1 | 2.0 | 43.7 | 9.474868 | 4.3344e−10 | 1.00000 | B | 0.345538 | 0.045826 |
| EAxxxQ | HHhhhH | 45.2 | 18.8 | 422.8 | 6.237266 | 4.7014e−10 | 1.00000 | N | 0.106906 | 0.044414 |
| SPxxxS | ECceeE | 38.1 | 14.9 | 211.2 | 6.241420 | 5.0762e−10 | 1.00000 | N | 0.180398 | 0.070475 |
| TPxxxK | CHhhhH | 42.6 | 17.4 | 322.0 | 6.202797 | 6.0232e−10 | 1.00000 | N | 0.132298 | 0.054102 |
| GAxxxE | CChhhH | 24.1 | 7.5 | 181.1 | 6.195949 | 9.3108e−10 | 1.00000 | N | 0.133076 | 0.041378 |
| SGxxxS | CCchhH | 29.0 | 10.1 | 190.4 | 6.139692 | 1.1318e−09 | 1.00000 | N | 0.152311 | 0.052802 |
| EGxxxE | CChhhH | 22.3 | 6.7 | 113.1 | 6.173709 | 1.1489e−09 | 1.00000 | N | 0.197171 | 0.059666 |
| GIxxxE | CChhhH | 25.4 | 8.2 | 190.6 | 6.143827 | 1.2211e−09 | 1.00000 | N | 0.133263 | 0.042994 |
| GQxxxK | CChhhH | 15.4 | 2.3 | 38.6 | 8.950992 | 1.3046e−09 | 1.00000 | B | 0.398964 | 0.059134 |
| DSxxxR | HHhhhH | 25.5 | 8.4 | 161.5 | 6.050940 | 2.1286e−09 | 1.00000 | N | 0.157895 | 0.052091 |
| FPxxxA | CChhhH | 15.2 | 2.1 | 79.8 | 9.135392 | 2.2216e−09 | 1.00000 | B | 0.190476 | 0.026431 |
| GExxxQ | CChhhH | 16.3 | 2.6 | 51.0 | 8.660100 | 2.2929e−09 | 1.00000 | B | 0.319608 | 0.051527 |
| TQxxxS | EEeccE | 26.8 | 9.1 | 251.1 | 6.004098 | 2.6913e−09 | 1.00000 | N | 0.106730 | 0.036075 |
| SAxxxR | CCcccH | 11.7 | 1.1 | 36.6 | 10.133488 | 2.8456e−09 | 1.00000 | B | 0.319672 | 0.030705 |
| DKxxxP | HHhccC | 19.5 | 5.7 | 86.1 | 6.017973 | 3.3049e−09 | 1.00000 | N | 0.226481 | 0.065745 |
| KLxxxE | CChhhH | 27.3 | 9.4 | 234.8 | 5.963685 | 3.3721e−09 | 1.00000 | N | 0.116269 | 0.040002 |
| GIxxxT | CChhhH | 22.5 | 5.0 | 143.4 | 7.993685 | 3.5299e−09 | 1.00000 | B | 0.156904 | 0.034712 |

TABLE 29

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STxxDK | CEeeEE | 59.1 | 14.2 | 254.5 | 12.233583 | 5.4622e-34 | 1.00000 | N | 0.232220 | 0.055962 |
| SAxxGR | CCccHH | 15.6 | 0.1 | 46.1 | 49.079185 | 2.2129e-29 | 1.00000 | B | 0.338395 | 0.002168 |
| TKxxKK | EEeeEE | 66.1 | 19.3 | 341.6 | 10.992116 | 7.5992e-28 | 1.00000 | N | 0.193501 | 0.056354 |
| TQxxKT | CCccHH | 15.3 | 0.2 | 14.3 | 29.339724 | 1.6806e-25 | 1.00000 | B | 1.069930 | 0.016341 |
| ERxxMD | HHhhEC | 15.1 | 0.2 | 36.2 | 30.598992 | 8.7736e-24 | 1.00000 | B | 0.417127 | 0.006560 |
| PTxxIG | CEecCC | 14.3 | 0.2 | 12.4 | 30.481402 | 5.0639e-23 | 1.00000 | B | 1.153226 | 0.013170 |
| SAxxGR | CCccCH | 11.7 | 0.1 | 21.6 | 43.188076 | 9.9068e-23 | 1.00000 | B | 0.541667 | 0.003367 |
| LSxxYH | HHhhHH | 26.5 | 2.5 | 52.5 | 15.583360 | 4.0718e-21 | 1.00000 | B | 0.504762 | 0.047463 |
| GSxxST | CChhHH | 17.9 | 0.8 | 49.1 | 19.913960 | 7.6094e-20 | 1.00000 | B | 0.364562 | 0.015335 |
| YAxxRT | HHccCC | 18.3 | 1.0 | 30.1 | 17.537770 | 1.2259e-19 | 1.00000 | B | 0.607973 | 0.033422 |
| CSxxIG | CCccCC | 8.5 | 0.0 | 12.3 | 52.662194 | 1.3010e-19 | 1.00000 | B | 0.691057 | 0.002110 |
| TGxxKT | CCccHH | 24.5 | 2.2 | 85.8 | 15.179670 | 9.8763e-19 | 1.00000 | B | 0.285548 | 0.025790 |
| TExxSI | HHhcCC | 3.0 | 0.1 | 2.0 | 7.770443 | 1.3782e-17 | 1.00000 | B | 1.500000 | 0.032062 |
| CSxxVG | CCccCH | 6.8 | 0.0 | 16.0 | 77.222504 | 2.0499e-17 | 1.00000 | B | 0.425000 | 0.000484 |
| QSxxSL | EEccEE | 25.0 | 5.4 | 183.2 | 8.519344 | 5.1349e-17 | 1.00000 | N | 0.136463 | 0.029668 |
| NAxxQV | CCchHH | 1.0 | 0.0 | 1.0 | 4.478223 | 1.0575e-16 | 1.00000 | B | 1.000000 | 0.047496 |
| QLxxRQ | HHhhCC | 1.0 | 0.0 | 1.0 | 5.045279 | 1.0683e-16 | 1.00000 | B | 1.000000 | 0.037800 |
| ERxxAM | CCccCC | 1.0 | 0.0 | 1.0 | 5.111929 | 1.0693e-16 | 1.00000 | B | 1.000000 | 0.036867 |
| LLxxDN | HHhhHC | 1.0 | 0.0 | 1.0 | 5.969702 | 1.0799e-16 | 1.00000 | B | 1.000000 | 0.027295 |
| DDxxFV | CCccCE | 1.0 | 0.0 | 1.0 | 6.356999 | 1.0834e-16 | 1.00000 | B | 1.000000 | 0.024148 |
| GSxxAE | CEecCE | 1.0 | 0.0 | 1.0 | 7.378896 | 1.0902e-16 | 1.00000 | B | 1.000000 | 0.018035 |
| ITxxVF | ECccEE | 1.0 | 0.0 | 1.0 | 8.484434 | 1.0950e-16 | 1.00000 | B | 1.000000 | 0.013170 |
| SSxxVD | HCeeEE | 40.7 | 12.3 | 215.6 | 8.311402 | 1.6093e-16 | 1.00000 | N | 0.188776 | 0.057261 |
| QGxxLG | CCccHH | 9.0 | 0.2 | 9.3 | 21.852434 | 4.1091e-16 | 1.00000 | B | 0.967742 | 0.017891 |
| RIxxNL | HHhhHH | 16.5 | 1.0 | 44.0 | 15.841191 | 4.4922e-16 | 1.00000 | B | 0.375000 | 0.022308 |
| CHxxYR | HHhhHC | 10.0 | 0.3 | 10.0 | 17.416672 | 1.0961e-15 | 1.00000 | B | 1.000000 | 0.031914 |
| VAxxNG | ECccCC | 21.6 | 2.4 | 46.6 | 12.569376 | 1.5977e-15 | 1.00000 | B | 0.463519 | 0.052575 |
| LDxxGK | CCccCH | 11.3 | 0.3 | 39.1 | 20.968186 | 2.4107e-15 | 1.00000 | B | 0.289003 | 0.007117 |
| SWxxGC | EEccCC | 15.3 | 0.8 | 129.4 | 15.971916 | 6.7763e-15 | 1.00000 | B | 0.118238 | 0.006387 |
| SGxxKS | CCccHH | 20.0 | 2.0 | 75.4 | 12.863878 | 7.1564e-15 | 1.00000 | B | 0.265252 | 0.026650 |
| WKxxFT | HHhcCC | 9.4 | 0.2 | 14.5 | 22.543920 | 7.4766e-15 | 1.00000 | B | 0.648276 | 0.011698 |
| QTxxGK | CCccCH | 13.5 | 0.6 | 41.8 | 16.189713 | 2.0888e-14 | 1.00000 | B | 0.322967 | 0.015328 |
| NTxxDK | CEeeEE | 28.8 | 7.8 | 135.9 | 7.708178 | 2.6509e-14 | 1.00000 | N | 0.211921 | 0.057719 |
| RMxxFK | HHccCC | 9.5 | 0.2 | 10.7 | 18.948412 | 2.7945e-14 | 1.00000 | B | 0.887850 | 0.022821 |
| KCxxCH | HCccCC | 10.6 | 0.4 | 12.6 | 17.091511 | 2.8775e-14 | 1.00000 | B | 0.841270 | 0.029296 |
| LGxxIV | CCeeEE | 9.3 | 0.2 | 37.1 | 21.972185 | 8.4861e-14 | 1.00000 | B | 0.250674 | 0.004672 |
| CLxxIC | ECccCC | 6.0 | 0.0 | 9.0 | 35.053684 | 9.5349e-14 | 1.00000 | B | 0.666667 | 0.003234 |
| YHxxNE | HHhhHH | 19.5 | 2.4 | 46.3 | 11.422064 | 2.0039e-13 | 1.00000 | B | 0.421166 | 0.051197 |
| LVxxHE | HHhhHH | 8.9 | 0.1 | 52.2 | 23.129204 | 2.5855e-13 | 1.00000 | B | 0.170649 | 0.002753 |
| IVxxTP | ECccCC | 9.3 | 0.2 | 23.0 | 19.542690 | 3.1552e-13 | 1.00000 | B | 0.404348 | 0.009480 |
| LDxxGK | ECccCH | 7.3 | 0.1 | 6.4 | 28.478746 | 3.3239e-13 | 1.00000 | B | 1.140625 | 0.007829 |
| GKxxAH | CHhhHH | 10.0 | 0.4 | 9.1 | 14.125237 | 6.7470e-13 | 1.00000 | B | 1.098901 | 0.043619 |
| DNxxKT | CCccHH | 10.3 | 0.4 | 16.6 | 15.371814 | 9.7383e-13 | 1.00000 | B | 0.620482 | 0.025519 |
| CSxxIG | CCccCH | 4.8 | 0.0 | 11.4 | 73.811659 | 1.4691e-12 | 1.00000 | B | 0.421053 | 0.000370 |
| ATxxRV | CCchHH | 8.3 | 0.2 | 7.7 | 19.415438 | 1.7742e-12 | 1.00000 | B | 1.077922 | 0.020018 |
| QCxxCH | HHhhHH | 13.0 | 1.0 | 22.0 | 12.026076 | 1.9167e-12 | 1.00000 | B | 0.590909 | 0.047197 |
| DGxxGK | CCccHH | 15.5 | 1.3 | 97.0 | 12.448014 | 2.8267e-12 | 1.00000 | B | 0.159794 | 0.013569 |
| ACxxDS | CCccCC | 9.1 | 0.2 | 75.1 | 18.214718 | 3.0063e-12 | 1.00000 | B | 0.121172 | 0.003162 |
| GSxxTT | CCchHH | 11.2 | 0.6 | 31.0 | 14.187378 | 4.0789e-12 | 1.00000 | B | 0.361290 | 0.018443 |
| LGxxCR | CCccCH | 5.5 | 0.0 | 10.3 | 37.032677 | 6.6138e-12 | 1.00000 | B | 0.533981 | 0.002129 |
| GTxxTF | CCchHH | 8.0 | 0.2 | 12.8 | 16.365802 | 1.0631e-11 | 1.00000 | B | 0.625000 | 0.017934 |
| SSxxNT | CCccHH | 7.0 | 0.1 | 6.5 | 21.121389 | 1.2770e-11 | 1.00000 | B | 1.076923 | 0.014361 |
| AAxxTT | CCchHH | 9.0 | 0.3 | 18.3 | 14.828063 | 1.6044e-11 | 1.00000 | B | 0.491803 | 0.018968 |
| NAxxTT | CCchHH | 9.3 | 0.3 | 26.0 | 15.589019 | 1.7742e-11 | 1.00000 | B | 0.357692 | 0.012886 |
| SPxxLS | ECceEE | 30.0 | 9.7 | 170.2 | 6.744862 | 2.3659e-11 | 1.00000 | N | 0.176263 | 0.056698 |
| GVxxSA | CCchHH | 13.4 | 1.1 | 67.0 | 12.144064 | 2.4899e-11 | 1.00000 | B | 0.200000 | 0.015680 |
| FPxxLT | HHhhHH | 19.4 | 3.0 | 59.9 | 9.792754 | 2.7723e-11 | 1.00000 | B | 0.323873 | 0.049478 |
| KNxxCK | EEecCC | 13.7 | 1.2 | 42.0 | 11.504674 | 3.8780e-11 | 1.00000 | B | 0.326190 | 0.028883 |
| DSxxGK | CCccHH | 11.3 | 0.7 | 45.5 | 12.872679 | 4.9903e-11 | 1.00000 | B | 0.248352 | 0.015161 |
| PGxxAL | CChhHC | 10.3 | 0.7 | 15.5 | 11.882512 | 7.8512e-11 | 1.00000 | B | 0.664516 | 0.044128 |
| PSxxGK | CCccCH | 8.0 | 0.2 | 33.5 | 15.968086 | 8.7729e-11 | 1.00000 | B | 0.238806 | 0.007104 |
| QGxxKT | CCccHH | 6.2 | 0.1 | 11.9 | 20.953421 | 9.3677e-11 | 1.00000 | B | 0.521008 | 0.007207 |
| AKxxNF | CCccCE | 7.3 | 0.2 | 20.8 | 18.084245 | 9.7158e-11 | 1.00000 | B | 0.350962 | 0.007557 |
| NDxxGG | CChhHC | 8.6 | 0.4 | 12.7 | 14.018717 | 1.3495e-10 | 1.00000 | B | 0.677165 | 0.028017 |
| RIxxYT | EEccCC | 9.0 | 0.4 | 49.0 | 13.900228 | 1.8474e-10 | 1.00000 | B | 0.183673 | 0.007898 |
| DAxxKT | CCccHH | 9.0 | 0.4 | 20.0 | 12.940407 | 1.8643e-10 | 1.00000 | B | 0.450000 | 0.022343 |
| HHxxLP | EEeeCC | 4.4 | 0.0 | 9.4 | 41.428721 | 1.9001e-10 | 1.00000 | B | 0.468085 | 0.001195 |
| VSxxCI | HHccCH | 4.0 | 0.0 | 6.0 | 36.564258 | 2.3293e-10 | 1.00000 | B | 0.666667 | 0.001987 |
| PNxxGK | CCccCH | 7.0 | 0.2 | 25.1 | 16.489979 | 3.2368e-10 | 1.00000 | B | 0.278884 | 0.006877 |
| QTxxAK | HHhhHH | 11.5 | 0.9 | 25.1 | 11.041981 | 3.3849e-10 | 1.00000 | B | 0.458167 | 0.037806 |
| GQxxMS | CChhHH | 5.0 | 0.1 | 5.0 | 19.598731 | 3.5034e-10 | 1.00000 | B | 1.000000 | 0.012850 |
| EAxxAE | HHhhHH | 21.2 | 4.2 | 95.4 | 8.498906 | 7.3395e-10 | 1.00000 | B | 0.222222 | 0.043919 |
| DNxxVP | CChhHH | 5.3 | 0.0 | 4.0 | 27.167952 | 8.4410e-10 | 1.00000 | B | 1.325000 | 0.005390 |
| QCxxCW | CCecHH | 4.2 | 0.0 | 9.5 | 34.016093 | 8.4522e-10 | 1.00000 | B | 0.442105 | 0.001596 |
| MExxTL | EEccCC | 7.0 | 0.3 | 9.1 | 13.024031 | 8.9179e-10 | 1.00000 | B | 0.769231 | 0.030212 |
| QCxxCW | CCccHH | 4.8 | 0.0 | 20.2 | 33.654743 | 1.0099e-09 | 1.00000 | B | 0.237624 | 0.001000 |
| GLxxWK | EEccCC | 6.2 | 0.1 | 13.4 | 16.284448 | 2.1044e-09 | 1.00000 | B | 0.462687 | 0.010444 |

TABLE 29-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| TVxxNE | CHhhHH | 8.8 | 0.6 | 11.6 | 11.143008 | 2.1359e−09 | 1.00000 | B | 0.758621 | 0.049430 |
| QVxxYG | CCccHH | 6.8 | 0.2 | 7.1 | 13.693903 | 2.2761e−09 | 1.00000 | B | 0.957746 | 0.033465 |
| NQxxNR | HHchHH | 12.9 | 1.5 | 47.3 | 9.598831 | 2.8315e−09 | 1.00000 | B | 0.272727 | 0.030964 |
| WGxxYA | CCccHH | 5.0 | 0.0 | 4.0 | 22.841046 | 3.3515e−09 | 1.00000 | B | 1.250000 | 0.007609 |
| VQxxGS | ECccCC | 20.1 | 4.1 | 109.8 | 8.109442 | 3.6024e−09 | 1.00000 | B | 0.183060 | 0.036992 |
| TWxxGE | EEccCE | 6.5 | 0.2 | 7.5 | 13.828612 | 3.7039e−09 | 1.00000 | B | 0.866667 | 0.028366 |
| PGxxKG | CCccHH | 10.8 | 0.9 | 34.8 | 10.398182 | 4.1662e−09 | 1.00000 | B | 0.310345 | 0.026618 |
| TDxxAW | CChhHH | 15.5 | 2.5 | 46.1 | 8.533841 | 5.0000e−09 | 1.00000 | B | 0.336226 | 0.053469 |
| GAxxTT | CCchHH | 9.0 | 0.6 | 23.9 | 10.640696 | 5.7397e−09 | 1.00000 | B | 0.376569 | 0.026564 |
| GLxxSI | ECeeEE | 5.5 | 0.1 | 6.2 | 16.659221 | 5.8987e−09 | 1.00000 | B | 0.887097 | 0.017201 |
| GVxxSN | CCchHH | 6.3 | 0.2 | 13.0 | 14.762570 | 6.5204e−09 | 1.00000 | B | 0.484615 | 0.013424 |
| SNxxNA | HHhhHH | 9.7 | 0.7 | 25.5 | 10.702628 | 6.6082e−09 | 1.00000 | B | 0.380392 | 0.028390 |
| GYxxNF | CCccCC | 8.8 | 0.6 | 19.7 | 10.906559 | 1.1072e−08 | 1.00000 | B | 0.446701 | 0.029682 |
| ACxxCH | CChhHH | 6.0 | 0.1 | 5.0 | 13.761477 | 1.1262e−08 | 1.00000 | B | 1.200000 | 0.025723 |
| NAxxSD | HHhhHH | 9.5 | 0.8 | 17.0 | 9.892985 | 1.1291e−08 | 1.00000 | B | 0.558824 | 0.047657 |
| GDxxDI | CCccCH | 6.0 | 0.2 | 10.7 | 13.237708 | 1.2867e−08 | 1.00000 | B | 0.560748 | 0.018302 |
| NSxxTT | CCchHH | 6.5 | 0.2 | 9.0 | 13.069026 | 1.2875e−08 | 1.00000 | B | 0.722222 | 0.026213 |
| GCxxCH | CHhhCC | 9.2 | 0.7 | 22.6 | 10.113297 | 1.3219e−08 | 1.00000 | B | 0.407080 | 0.032100 |
| LTxxHY | CEecCC | 5.0 | 0.1 | 8.0 | 15.932022 | 1.3450e−08 | 1.00000 | B | 0.625000 | 0.011987 |
| TCxxCH | HHHhHH | 8.8 | 0.6 | 17.1 | 10.560727 | 1.3572e−08 | 1.00000 | B | 0.514620 | 0.036036 |
| GVxxSS | CCchHH | 8.0 | 0.5 | 22.6 | 10.763572 | 1.6961e−08 | 1.00000 | B | 0.353982 | 0.021985 |
| MCxxAL | EEchHH | 5.7 | 0.1 | 5.0 | 13.068806 | 1.8614e−08 | 1.00000 | B | 1.140000 | 0.028442 |

TABLE 30

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STxVxK | CEeEeE | 64.0 | 12.0 | 256.9 | 15.417593 | 6.1069e−53 | 1.00000 | N | 0.249124 | 0.046526 |
| GSxKxT | CCcHhH | 34.1 | 0.8 | 86.9 | 37.367230 | 5.6913e−46 | 1.00000 | B | 0.392405 | 0.009223 |
| TKxDxT | EEeEeE | 66.5 | 16.5 | 338.4 | 12.643443 | 3.0096e−36 | 1.00000 | N | 0.196513 | 0.048650 |
| TQxGxT | CCcChH | 18.0 | 0.2 | 17.2 | 35.333617 | 2.8357e−32 | 1.00000 | B | 1.046512 | 0.013590 |
| CKxGxT | CCcCcC | 27.2 | 1.1 | 50.0 | 25.153537 | 9.5225e−32 | 1.00000 | B | 0.544000 | 0.022017 |
| VAxKxG | ECcCcC | 31.1 | 2.2 | 50.4 | 20.175102 | 6.0519e−30 | 1.00000 | B | 0.617063 | 0.042673 |
| CSxGxG | CCcCcH | 10.3 | 0.0 | 36.8 | 75.277474 | 2.5489e−25 | 1.00000 | B | 0.279891 | 0.000507 |
| FPxHxA | CCcHhH | 11.6 | 0.1 | 14.2 | 36.450813 | 4.1020e−22 | 1.00000 | B | 0.816901 | 0.007059 |
| SSxKxD | HCeEeE | 38.9 | 9.5 | 196.6 | 9.744738 | 4.9097e−22 | 1.00000 | N | 0.197864 | 0.048527 |
| PTxNxG | CEeCcC | 15.5 | 0.1 | 11.5 | 30.180949 | 2.1746e−21 | 1.00000 | B | 1.347826 | 0.012468 |
| AAxKxT | CCcHhH | 13.1 | 0.2 | 24.7 | 27.588401 | 7.5720e−21 | 1.00000 | B | 0.530364 | 0.008904 |
| GAxKxT | CCcHhH | 18.7 | 0.8 | 60.0 | 20.216935 | 2.7607e−20 | 1.00000 | B | 0.311667 | 0.013248 |
| YAxGxT | HHcCcC | 18.8 | 0.9 | 34.2 | 18.578825 | 3.4934e−20 | 1.00000 | B | 0.549708 | 0.027763 |
| SAxIxR | CCcCcH | 9.7 | 0.0 | 14.7 | 44.440313 | 4.2337e−20 | 1.00000 | B | 0.659864 | 0.003220 |
| NTxVxK | CEeEeE | 29.8 | 6.7 | 140.9 | 9.196737 | 1.1483e−19 | 1.00000 | N | 0.211498 | 0.047197 |
| GVxKxS | CCcHhH | 14.0 | 0.3 | 41.2 | 23.421845 | 2.3634e−19 | 1.00000 | B | 0.339806 | 0.008322 |
| ACxGxS | CCcCcC | 12.1 | 0.2 | 75.0 | 29.273930 | 2.9742e−19 | 1.00000 | B | 0.161333 | 0.002221 |
| GVxKxA | CCcHhH | 14.4 | 0.4 | 55.7 | 21.200156 | 8.0469e−18 | 1.00000 | B | 0.258528 | 0.007849 |
| LDxAxK | CCcCcH | 10.3 | 0.1 | 31.5 | 30.561504 | 1.0872e−17 | 1.00000 | B | 0.326984 | 0.003541 |
| FKxSxF | HCcCcC | 1.0 | 0.0 | 1.0 | 5.225860 | 1.0710e−16 | 1.00000 | B | 1.000000 | 0.035324 |
| ADxLxP | EEcCcC | 1.7 | 0.0 | 1.0 | 6.058210 | 1.0808e−16 | 1.00000 | B | 1.700000 | 0.026525 |
| ASxNxY | CEhHhH | 1.0 | 0.0 | 1.0 | 6.128737 | 1.0814e−16 | 1.00000 | B | 1.000000 | 0.025933 |
| EAxRxT | HHcCcH | 1.0 | 0.0 | 1.0 | 8.216078 | 1.0940e−16 | 1.00000 | B | 1.000000 | 0.014598 |
| SAxVxR | CCcChH | 8.3 | 0.1 | 18.1 | 35.643410 | 1.8927e−16 | 1.00000 | B | 0.458564 | 0.002966 |
| VSxGxG | EEeCcC | 15.7 | 0.7 | 142.8 | 17.308385 | 8.3711e−16 | 1.00000 | B | 0.109944 | 0.005252 |
| GTxKxF | CCcHhH | 8.0 | 0.1 | 9.8 | 27.471521 | 9.4328e−16 | 1.00000 | B | 0.816327 | 0.008546 |
| TGxGxT | CCcChH | 24.5 | 3.1 | 86.8 | 12.456089 | 1.4644e−15 | 1.00000 | B | 0.282258 | 0.035354 |
| QTxTxK | CCcCcH | 7.5 | 0.1 | 11.0 | 31.920048 | 1.2186e−14 | 1.00000 | B | 0.681818 | 0.004971 |
| MExCxL | EEcCcC | 7.0 | 0.1 | 9.1 | 27.627578 | 2.2583e−14 | 1.00000 | B | 0.769231 | 0.006976 |
| DNxGxT | CCcChH | 10.3 | 0.3 | 15.9 | 17.812272 | 5.0703e−14 | 1.00000 | B | 0.647799 | 0.020148 |
| RMxTxK | HHcCcC | 9.5 | 0.3 | 10.8 | 18.244981 | 5.8055e−14 | 1.00000 | B | 0.879630 | 0.024326 |
| CLxNxC | ECcCcC | 6.5 | 0.0 | 10.0 | 38.099027 | 6.1079e−14 | 1.00000 | B | 0.650000 | 0.002893 |
| GLxFxI | ECcEeE | 7.2 | 0.1 | 7.9 | 24.637453 | 8.3971e−14 | 1.00000 | B | 0.911392 | 0.010673 |
| NWxRxV | CHhHhH | 7.3 | 0.1 | 21.0 | 29.076095 | 1.5643e−13 | 1.00000 | B | 0.347619 | 0.002959 |
| SAxIxR | CCcChH | 7.3 | 0.1 | 20.6 | 28.942731 | 1.6267e−13 | 1.00000 | B | 0.354369 | 0.003045 |
| LDxAxK | ECcCcH | 7.0 | 0.0 | 5.5 | 43.537246 | 2.7400e−13 | 1.00000 | B | 1.272727 | 0.002893 |
| NAxKxT | CCcHhH | 9.3 | 0.2 | 16.7 | 18.667715 | 3.1319e−13 | 1.00000 | B | 0.556886 | 0.014312 |
| SGxGxS | CCcChH | 20.0 | 2.4 | 84.1 | 11.420009 | 3.1854e−13 | 1.00000 | B | 0.237812 | 0.028966 |
| TPxLxK | CCcCcH | 9.1 | 0.2 | 18.4 | 18.736598 | 3.4040e−13 | 1.00000 | B | 0.494565 | 0.012340 |
| DGxTxK | CCcCcH | 8.0 | 0.1 | 29.0 | 22.438199 | 4.3553e−13 | 1.00000 | B | 0.275862 | 0.004267 |
| NVxCxN | EEcCcC | 14.3 | 1.0 | 43.1 | 13.214649 | 6.2025e−13 | 1.00000 | B | 0.331787 | 0.023961 |
| SSxGxT | CCcChH | 8.0 | 0.2 | 11.0 | 18.713621 | 7.2943e−13 | 1.00000 | B | 0.727273 | 0.016145 |
| TQxPxS | EEeCcE | 25.8 | 6.9 | 245.4 | 7.260776 | 7.8442e−13 | 1.00000 | N | 0.105134 | 0.028289 |
| GVxKxN | CCcHhH | 6.3 | 0.1 | 12.0 | 26.995054 | 5.1295e−12 | 1.00000 | B | 0.525000 | 0.004482 |
| GGxWxF | CCcEeE | 5.5 | 0.0 | 12.0 | 37.207253 | 7.6246e−12 | 1.00000 | B | 0.458333 | 0.001810 |
| NVxKxS | CCcHhH | 7.5 | 0.2 | 10.3 | 18.894023 | 1.2990e−11 | 1.00000 | B | 0.728155 | 0.014900 |

TABLE 30-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| DAxGxT | CCcChH | 9.0 | 0.4 | 18.0 | 14.731130 | 1.7133e−11 | 1.00000 | B | 0.500000 | 0.019530 |
| NSxKxT | CCcHhH | 6.5 | 0.1 | 9.0 | 21.907899 | 3.2501e−11 | 1.00000 | B | 0.722222 | 0.009615 |
| IVxYxP | ECcCcC | 10.3 | 0.6 | 23.0 | 13.217500 | 4.2034e−11 | 1.00000 | B | 0.447826 | 0.024211 |
| RIxNxT | EEcCcC | 9.0 | 0.3 | 49.0 | 15.035039 | 5.1668e−11 | 1.00000 | B | 0.183673 | 0.006826 |
| KCxAxH | HCcCcC | 7.0 | 0.1 | 6.1 | 17.691757 | 5.5611e−11 | 1.00000 | B | 1.147541 | 0.019116 |
| RLxPxE | HCcChH | 8.0 | 0.4 | 8.5 | 12.478417 | 6.3808e−11 | 1.00000 | B | 0.941176 | 0.045861 |
| GQxIxS | CCcHhH | 7.0 | 0.2 | 9.0 | 15.467350 | 8.5625e−11 | 1.00000 | B | 0.777778 | 0.021972 |
| GDxHxI | CCcCcH | 6.0 | 0.1 | 6.2 | 16.372862 | 1.4245e−10 | 1.00000 | B | 0.967742 | 0.021171 |
| SWxRxC | EEcCcC | 4.3 | 0.0 | 5.3 | 36.955945 | 2.1112e−10 | 1.00000 | B | 0.811321 | 0.002545 |
| DSxVxK | CCcCcH | 8.3 | 0.3 | 37.5 | 15.339191 | 2.1634e−10 | 1.00000 | B | 0.221333 | 0.007352 |
| FTxAxN | CChHhH | 7.8 | 0.3 | 13.0 | 15.243971 | 3.2013e−10 | 1.00000 | B | 0.600000 | 0.019239 |
| HHxExP | EEeEcC | 5.4 | 0.0 | 9.4 | 24.178681 | 3.9133e−10 | 1.00000 | B | 0.574468 | 0.005237 |
| NQxPxR | HHcHhH | 12.9 | 1.3 | 49.2 | 10.416783 | 6.2879e−10 | 1.00000 | B | 0.262195 | 0.025975 |
| RGxGxG | CCcChH | 11.5 | 1.0 | 29.8 | 10.632146 | 9.6622e−10 | 1.00000 | B | 0.385906 | 0.033823 |
| PNxSxK | CCcCcH | 5.0 | 0.1 | 10.1 | 21.548123 | 1.0440e−09 | 1.00000 | B | 0.495050 | 0.005246 |
| EExGxW | CCcCcE | 6.0 | 0.1 | 11.1 | 16.481972 | 1.1317e−09 | 1.00000 | B | 0.540541 | 0.011567 |
| SPxSxS | ECcEeE | 19.5 | 5.5 | 115.4 | 6.119672 | 1.8049e−09 | 1.00000 | N | 0.168977 | 0.047638 |
| EFxFxD | CCcCcC | 9.7 | 0.7 | 16.0 | 10.750240 | 2.3506e−09 | 1.00000 | B | 0.606250 | 0.045597 |
| QGxGxG | CCcChH | 8.5 | 0.5 | 15.0 | 11.884559 | 2.5652e−09 | 1.00000 | B | 0.566667 | 0.031413 |
| GTxKxT | CCcHhH | 9.0 | 0.5 | 53.1 | 11.802594 | 2.5828e−09 | 1.00000 | B | 0.169492 | 0.009815 |
| LGxIxR | CCcCcH | 4.0 | 0.0 | 7.8 | 27.243385 | 3.4482e−09 | 1.00000 | B | 0.512821 | 0.002742 |
| SDxAxN | ECcCcC | 6.0 | 0.2 | 8.0 | 13.656497 | 4.1912e−09 | 1.00000 | B | 0.750000 | 0.023197 |
| KNxFxV | HHcCcH | 6.3 | 0.2 | 8.0 | 13.833088 | 4.5236e−09 | 1.00000 | B | 0.787500 | 0.024933 |
| CSxGxG | CCcCcC | 8.3 | 0.4 | 31.0 | 12.038413 | 6.1081e−09 | 1.00000 | B | 0.267742 | 0.013971 |
| LGxSxV | CCeEeE | 6.0 | 0.1 | 20.2 | 15.206575 | 6.1464e−09 | 1.00000 | B | 0.297030 | 0.007383 |
| NYxPxL | CCcCcC | 11.1 | 1.1 | 37.6 | 9.595732 | 7.2007e−09 | 1.00000 | B | 0.295213 | 0.029674 |
| SCxQxT | CCcEeE | 10.1 | 0.9 | 32.0 | 10.049367 | 7.2459e−09 | 1.00000 | B | 0.315625 | 0.027111 |
| NRxKxT | HHcCcC | 14.5 | 2.2 | 44.1 | 8.614814 | 7.3085e−09 | 1.00000 | B | 0.328798 | 0.048936 |
| GFxIxG | CEeEeE | 6.5 | 0.2 | 34.1 | 15.573549 | 8.3341e−09 | 1.00000 | B | 0.190616 | 0.004874 |
| QVxGxG | CCcChH | 6.8 | 0.3 | 7.1 | 12.055621 | 9.8300e−09 | 1.00000 | B | 0.957746 | 0.042727 |
| QRxGxG | CCcChH | 9.0 | 0.7 | 19.0 | 9.982543 | 9.9913e−09 | 1.00000 | B | 0.473684 | 0.037666 |
| KNxAxK | EEcCcC | 13.7 | 1.9 | 42.0 | 8.661753 | 1.1168e−08 | 1.00000 | B | 0.326190 | 0.046053 |
| QAxCxQ | HHhHhC | 11.3 | 1.2 | 45.4 | 9.439394 | 1.3106e−08 | 1.00000 | B | 0.248899 | 0.025993 |
| STxExT | EEeEeE | 11.4 | 1.3 | 30.4 | 9.145725 | 1.3944e−08 | 1.00000 | B | 0.375000 | 0.042057 |
| KDxRxE | CCcCcC | 9.8 | 0.8 | 23.0 | 9.956334 | 1.4414e−08 | 1.00000 | B | 0.426087 | 0.036543 |
| GHxYxT | CCcHhH | 6.0 | 0.1 | 5.1 | 13.618973 | 1.5371e−08 | 1.00000 | B | 1.176471 | 0.026761 |
| YRxLxV | HCcEeE | 5.0 | 0.1 | 5.0 | 13.141823 | 1.7633e−08 | 1.00000 | B | 1.000000 | 0.028136 |
| PGxGxG | CCcChH | 10.8 | 1.1 | 38.1 | 9.489389 | 2.0316e−08 | 1.00000 | B | 0.283465 | 0.028342 |
| RExGxS | EEcCcC | 11.3 | 1.2 | 49.0 | 9.175646 | 2.2602e−08 | 1.00000 | B | 0.230612 | 0.025193 |
| GTxKxC | CCcHhH | 4.0 | 0.0 | 7.1 | 20.814784 | 2.5870e−08 | 1.00000 | B | 0.563380 | 0.005133 |
| QCxSxW | CCcChH | 4.4 | 0.0 | 23.8 | 23.337447 | 2.8327e−08 | 1.00000 | B | 0.184874 | 0.001472 |
| TAxLxL | ECcCeE | 3.0 | 0.0 | 4.0 | 33.845437 | 2.9972e−08 | 1.00000 | B | 0.750000 | 0.001958 |
| SGxGxT | CCcChH | 13.9 | 2.1 | 76.1 | 8.298731 | 3.2053e−08 | 1.00000 | B | 0.182654 | 0.027389 |
| KQxTxN | CEeEeE | 11.7 | 1.5 | 31.3 | 8.462380 | 4.9081e−08 | 1.00000 | B | 0.373802 | 0.048588 |
| DKxGxP | HHhCcC | 15.4 | 2.8 | 61.6 | 7.726483 | 5.0446e−08 | 1.00000 | B | 0.250000 | 0.045292 |
| EYxPxG | CCcCcC | 9.3 | 0.9 | 25.5 | 9.162766 | 7.1809e−08 | 1.00000 | B | 0.364706 | 0.034330 |
| SPxLxD | CCcCcC | 8.4 | 0.6 | 27.7 | 9.963668 | 7.7018e−08 | 1.00000 | B | 0.303249 | 0.022499 |
| QSxSxL | EEcCeE | 15.7 | 2.8 | 127.3 | 7.707213 | 8.1135e−08 | 1.00000 | B | 0.123331 | 0.022352 |
| KMxFxL | CCcCcC | 6.3 | 0.3 | 12.6 | 11.723551 | 8.2273e−08 | 1.00000 | B | 0.500000 | 0.021454 |
| ELxPxR | CCcCcE | 5.7 | 0.2 | 7.0 | 12.480023 | 1.1672e−07 | 1.00000 | B | 0.814286 | 0.028562 |
| GQxGxC | CCcCcH | 7.0 | 0.4 | 19.7 | 10.157502 | 1.2223e−07 | 1.00000 | B | 0.355330 | 0.021722 |
| TKxFxN | EEeEcC | 4.4 | 0.1 | 8.4 | 18.030242 | 1.2284e−07 | 1.00000 | B | 0.523810 | 0.006951 |
| QGxGxT | CCcChH | 6.2 | 0.3 | 13.0 | 11.287013 | 1.2372e−07 | 1.00000 | B | 0.476923 | 0.021621 |

TABLE 31

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STxVDK | CEeEEE | 58.1 | 9.7 | 253.5 | 15.835199 | 1.1831e−55 | 1.00000 | N | 0.229191 | 0.038304 |
| TKxDKK | EEeEEE | 66.1 | 13.1 | 336.4 | 14.928529 | 8.7974e−50 | 1.00000 | N | 0.196492 | 0.038972 |
| SSxKVD | HCeEEE | 38.4 | 7.7 | 196.6 | 11.327509 | 3.8624e−29 | 1.00000 | N | 0.195320 | 0.038973 |
| TQxGKT | CCcCHH | 15.3 | 0.2 | 14.3 | 32.629967 | 8.9626e−27 | 1.00000 | B | 1.069930 | 0.013253 |
| GSxKST | CCcHHH | 17.9 | 0.3 | 44.0 | 31.715529 | 1.6123e−26 | 1.00000 | B | 0.406818 | 0.007041 |
| SAxIGR | CCcCCH | 9.7 | 0.0 | 14.7 | 89.096764 | 1.6309e−25 | 1.00000 | B | 0.659864 | 0.000805 |
| NTxVDK | CEeEEEE | 28.8 | 5.4 | 135.9 | 10.341170 | 2.2370e−24 | 1.00000 | N | 0.211921 | 0.039382 |
| YAxGRT | HHcCCC | 18.3 | 0.7 | 30.1 | 21.449600 | 1.5545e−22 | 1.00000 | B | 0.607973 | 0.022919 |
| CSxGIG | CCcCCC | 6.3 | 0.0 | 11.9 | 189.417992 | 3.9006e−22 | 1.00000 | B | 0.529412 | 0.000093 |
| LDxAGK | CCcCCH | 10.3 | 0.0 | 30.5 | 47.444266 | 1.7930e−21 | 1.00000 | B | 0.337705 | 0.001534 |
| TGxGKT | CCcCHH | 24.5 | 1.7 | 83.7 | 17.637210 | 2.4487e−21 | 1.00000 | B | 0.292712 | 0.020372 |
| SAxVGR | CCcCHH | 8.3 | 0.0 | 18.1 | 71.080806 | 3.2725e−21 | 1.00000 | B | 0.458564 | 0.000751 |
| SGxGKS | CCcCHH | 20.0 | 1.1 | 73.1 | 18.620112 | 3.0285e−20 | 1.00000 | B | 0.273598 | 0.014374 |
| PTxNIG | CEeCCC | 14.3 | 0.1 | 10.3 | 28.371217 | 1.6378e−19 | 1.00000 | B | 1.388350 | 0.012635 |
| SAxIGR | CCcCHH | 7.3 | 0.0 | 20.0 | 71.573397 | 5.4679e−19 | 1.00000 | B | 0.365000 | 0.000519 |

TABLE 31-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GTxVVG | CCcHHH | 2.0 | 0.0 | 2.0 | 11.343455 | 6.6929e−18 | 1.00000 | B | 1.000000 | 0.015305 |
| VAxKNG | ECcCCC | 20.6 | 1.6 | 43.0 | 15.114508 | 7.1138e−18 | 1.00000 | B | 0.479070 | 0.038057 |
| GVxKSA | CCcHHH | 12.4 | 0.2 | 44.6 | 24.691608 | 9.2568e−18 | 1.00000 | B | 0.278027 | 0.005464 |
| ACxGDS | CCcCCC | 9.1 | 0.1 | 72.0 | 37.337944 | 1.1616e−17 | 1.00000 | B | 0.126389 | 0.000815 |
| DNxGKT | CCcCHH | 10.3 | 0.1 | 15.9 | 26.867787 | 1.8321e−17 | 1.00000 | B | 0.647799 | 0.009068 |
| RSxFLE | CCcHHH | 1.0 | 0.0 | 1.0 | 5.834083 | 1.0785e−16 | 1.00000 | B | 1.000000 | 0.028542 |
| GTxKPV | CCcCCE | 1.7 | 0.0 | 1.0 | 6.259571 | 1.0826e−16 | 1.00000 | B | 1.700000 | 0.024887 |
| ASxNTY | CEhHHH | 1.0 | 0.0 | 1.0 | 6.291002 | 1.0829e−16 | 1.00000 | B | 1.000000 | 0.024645 |
| YIxIHA | EEcCCC | 1.5 | 0.0 | 1.0 | 6.690226 | 1.0860e−16 | 1.00000 | B | 1.500000 | 0.021854 |
| DDxRFV | CCcCCE | 1.0 | 0.0 | 1.0 | 7.147748 | 1.0889e−16 | 1.00000 | B | 1.000000 | 0.019197 |
| GYxDNG | CCeEEE | 1.0 | 0.0 | 1.0 | 19.741459 | 1.1074e−16 | 1.00000 | B | 1.000000 | 0.002559 |
| DGxTGK | CCcCCH | 8.0 | 0.0 | 29.0 | 37.332124 | 1.5231e−16 | 1.00000 | B | 0.275862 | 0.001568 |
| GSxKTT | CCcHHH | 11.2 | 0.2 | 31.0 | 23.154082 | 1.8616e−16 | 1.00000 | B | 0.361290 | 0.007299 |
| NAxKTT | CCcHHH | 9.3 | 0.1 | 14.1 | 26.923386 | 2.8401e−16 | 1.00000 | B | 0.659574 | 0.008319 |
| CSxGVG | CCcCCH | 5.8 | 0.0 | 16.0 | 101.911600 | 2.9554e−16 | 1.00000 | B | 0.362500 | 0.000202 |
| CLxNIC | ECcCCC | 6.0 | 0.0 | 9.0 | 54.727710 | 4.6743e−16 | 1.00000 | B | 0.666667 | 0.001332 |
| DAxGKT | CCcCHH | 9.0 | 0.1 | 18.0 | 25.724945 | 1.1942e−15 | 1.00000 | B | 0.500000 | 0.006664 |
| GTxKTF | CCcCHH | 8.0 | 0.1 | 9.8 | 25.326602 | 3.3955e−15 | 1.00000 | B | 0.816327 | 0.010033 |
| AAxKTT | CCcHHH | 9.0 | 0.1 | 18.0 | 23.672806 | 5.1140e−15 | 1.00000 | B | 0.500000 | 0.007842 |
| RMxTFK | HHcCCC | 9.5 | 0.2 | 10.7 | 20.171854 | 9.3741e−15 | 1.00000 | B | 0.887850 | 0.020204 |
| LDxAGK | ECcCCH | 7.0 | 0.0 | 5.5 | 57.251217 | 1.7841e−14 | 1.00000 | B | 1.272727 | 0.001675 |
| GAxKTT | CCcHHH | 9.0 | 0.2 | 17.1 | 21.498820 | 2.3496e−14 | 1.00000 | B | 0.526316 | 0.009963 |
| IVxYTP | ECcCCC | 9.3 | 0.2 | 22.0 | 21.346526 | 6.3228e−14 | 1.00000 | B | 0.422727 | 0.008360 |
| CSxGIG | CCcCCH | 4.5 | 0.0 | 11.4 | 110.094950 | 8.9687e−14 | 1.00000 | B | 0.394737 | 0.000146 |
| QTxTGK | CCcCCH | 7.5 | 0.1 | 10.0 | 26.708621 | 1.0200e−13 | 1.00000 | B | 0.750000 | 0.007783 |
| MExCTL | EEcCCC | 7.0 | 0.1 | 9.1 | 23.929635 | 2.3636e−13 | 1.00000 | B | 0.769231 | 0.009264 |
| GVxKSS | CCcHHH | 8.0 | 0.1 | 18.1 | 21.088337 | 5.5327e−13 | 1.00000 | B | 0.441989 | 0.007735 |
| GQxIMS | CCcHHH | 5.0 | 0.0 | 5.0 | 37.108769 | 6.1975e−13 | 1.00000 | B | 1.000000 | 0.003618 |
| PNxSGK | CCcCCH | 5.0 | 0.0 | 10.1 | 43.402993 | 1.0258e−12 | 1.00000 | B | 0.495050 | 0.001309 |
| SSxGNT | CCcCCH | 7.0 | 0.1 | 6.0 | 23.356780 | 1.6575e−12 | 1.00000 | B | 1.166667 | 0.010879 |
| DSxVGK | CCcCCH | 8.3 | 0.2 | 37.5 | 20.844667 | 2.1531e−12 | 1.00000 | B | 0.221333 | 0.004090 |
| LGxSIV | CCeEEE | 6.0 | 0.0 | 14.0 | 27.547447 | 4.1259e−12 | 1.00000 | B | 0.428571 | 0.003347 |
| LGxICR | CCcCCH | 4.0 | 0.0 | 7.8 | 63.205494 | 4.2449e−12 | 1.00000 | B | 0.512821 | 0.000513 |
| NVxCKN | EEcCCC | 13.3 | 1.0 | 43.0 | 12.198471 | 1.2220e−11 | 1.00000 | B | 0.309302 | 0.024087 |
| GVxKSN | CCcHHH | 6.3 | 0.1 | 11.0 | 23.749628 | 1.9657e−11 | 1.00000 | B | 0.572727 | 0.006297 |
| KNxACK | EEeCCC | 13.7 | 1.1 | 42.0 | 11.874518 | 1.9766e−11 | 1.00000 | B | 0.326190 | 0.027349 |
| RIxNYT | EEcCCC | 9.0 | 0.3 | 46.0 | 15.336804 | 3.5576e−11 | 1.00000 | B | 0.195652 | 0.007009 |
| QCxSCW | CCcCHH | 4.4 | 0.0 | 20.2 | 52.509392 | 4.3647e−11 | 1.00000 | B | 0.217822 | 0.000347 |
| KCxACH | HCcCCC | 7.0 | 0.1 | 6.1 | 17.744020 | 5.3714e−11 | 1.00000 | B | 1.147541 | 0.019006 |
| PGxGKG | CCcCHH | 10.8 | 0.6 | 32.8 | 13.331730 | 5.3905e−11 | 1.00000 | B | 0.329268 | 0.018189 |
| VDxGKT | CCcCHH | 7.0 | 0.1 | 27.3 | 18.303355 | 8.7340e−11 | 1.00000 | B | 0.256410 | 0.005170 |
| GDxHDI | CCcCCH | 6.0 | 0.1 | 6.1 | 16.814988 | 9.2109e−11 | 1.00000 | B | 0.983607 | 0.020432 |
| NSxKTT | CCcHHH | 6.5 | 0.1 | 9.0 | 20.025056 | 9.3279e−11 | 1.00000 | B | 0.722222 | 0.011469 |
| PSxSGK | CCcCCH | 4.0 | 0.0 | 8.0 | 42.041347 | 1.1281e−10 | 1.00000 | B | 0.500000 | 0.001128 |
| NQxPNR | HHcHHH | 12.9 | 1.1 | 47.4 | 11.218153 | 1.4078e−10 | 1.00000 | B | 0.272152 | 0.023798 |
| QGxGKT | CCcCHH | 6.2 | 0.1 | 12.0 | 19.845816 | 1.7918e−10 | 1.00000 | B | 0.516667 | 0.007948 |
| GGxGKT | CCcCHH | 9.0 | 0.4 | 41.4 | 13.504582 | 2.5790e−10 | 1.00000 | B | 0.217391 | 0.009873 |
| EQxVGK | CCcCCH | 4.0 | 0.0 | 10.0 | 38.073494 | 3.0463e−10 | 1.00000 | B | 0.400000 | 0.001099 |
| SWxRGC | EEcCCC | 4.3 | 0.0 | 5.3 | 33.870887 | 4.2263e−10 | 1.00000 | B | 0.811321 | 0.003027 |
| LSxAGK | CCcCCH | 4.0 | 0.0 | 4.9 | 30.417945 | 6.6469e−10 | 1.00000 | B | 0.816327 | 0.003511 |
| QVxGYG | CCcCHH | 6.8 | 0.2 | 7.1 | 15.043578 | 7.6627e−10 | 1.00000 | B | 0.957746 | 0.027904 |
| VSxGCI | HHcCCH | 4.0 | 0.0 | 6.0 | 31.335851 | 7.9497e−10 | 1.00000 | B | 0.666667 | 0.002701 |
| HHxELP | EEeECC | 4.4 | 0.0 | 9.4 | 34.320537 | 8.4881e−10 | 1.00000 | B | 0.468085 | 0.001739 |
| TPxLPK | CCcCCH | 7.5 | 0.2 | 18.0 | 14.918687 | 1.0677e−09 | 1.00000 | B | 0.416667 | 0.013334 |
| ALxVPD | CCcCCC | 6.0 | 0.2 | 7.0 | 14.231812 | 1.5040e−09 | 1.00000 | B | 0.857143 | 0.024560 |
| QAxSGL | HHhHHH | 3.0 | 0.0 | 8.1 | 55.954042 | 2.5977e−09 | 1.00000 | B | 0.370370 | 0.000354 |
| HKxQSP | HHhCCC | 5.3 | 0.1 | 7.1 | 18.695085 | 2.7215e−09 | 1.00000 | B | 0.746479 | 0.011109 |
| LNxGMV | CEeEEE | 3.3 | 0.0 | 5.0 | 52.849045 | 3.3003e−09 | 1.00000 | B | 0.660000 | 0.000779 |
| KNxFTV | HHcCCH | 6.3 | 0.2 | 8.1 | 14.221970 | 3.4346e−09 | 1.00000 | B | 0.777778 | 0.023338 |
| RGxGIG | CCcCHH | 6.2 | 0.2 | 9.1 | 14.500182 | 3.6936e−09 | 1.00000 | B | 0.681319 | 0.019340 |
| PNxGKT | CCcCHH | 7.0 | 0.3 | 11.1 | 12.297662 | 3.8566e−09 | 1.00000 | B | 0.630631 | 0.027457 |
| QGxGIM | CCcCHH | 4.8 | 0.0 | 6.0 | 24.626370 | 4.6432e−09 | 1.00000 | B | 0.800000 | 0.006272 |
| WGxGYA | CCcCHH | 5.0 | 0.0 | 4.0 | 21.911256 | 4.6611e−09 | 1.00000 | B | 1.250000 | 0.008263 |
| TGxGKS | CCcCHH | 8.6 | 0.5 | 26.2 | 12.019779 | 5.3272e−09 | 1.00000 | B | 0.328244 | 0.017795 |
| GSxVEK | CEeEEE | 10.5 | 0.9 | 24.4 | 10.064493 | 5.4015e−09 | 1.00000 | B | 0.430328 | 0.038468 |
| EFxFPD | CCcCCC | 8.6 | 0.5 | 14.0 | 11.100589 | 5.5408e−09 | 1.00000 | B | 0.614286 | 0.039116 |
| VSxGRG | EEeCCC | 4.3 | 0.0 | 5.3 | 24.471776 | 5.5860e−09 | 1.00000 | B | 0.811321 | 0.005776 |
| VExTFP | CCcCCC | 8.6 | 0.6 | 14.0 | 11.070664 | 5.7586e−09 | 1.00000 | B | 0.614286 | 0.039309 |
| GTxKSC | CCcHHH | 4.0 | 0.0 | 5.1 | 23.127532 | 6.4409e−09 | 1.00000 | B | 0.784314 | 0.005812 |
| SDxAGN | ECcCCC | 6.0 | 0.1 | 5.0 | 14.505782 | 6.7366e−09 | 1.00000 | B | 1.200000 | 0.023211 |
| GAxKTS | CCcHHH | 4.6 | 0.0 | 6.0 | 24.335291 | 7.2209e−09 | 1.00000 | B | 0.766667 | 0.005899 |
| PNxGKS | CCcCHH | 8.0 | 0.4 | 27.7 | 11.511517 | 8.3860e−09 | 1.00000 | B | 0.288809 | 0.015827 |
| GYxDNF | CCcCCC | 7.8 | 0.4 | 16.8 | 12.300028 | 8.5367e−09 | 1.00000 | B | 0.464286 | 0.022196 |
| GHxYAT | CCcHHH | 5.0 | 0.0 | 4.0 | 20.057804 | 9.3926e−09 | 1.00000 | B | 1.250000 | 0.009845 |
| QAxCSQ | HHhHHC | 11.3 | 1.2 | 43.0 | 9.514827 | 1.0843e−08 | 1.00000 | B | 0.262791 | 0.027116 |
| SPxSLS | ECcEEE | 19.5 | 4.0 | 104.7 | 7.844474 | 1.1598e−08 | 1.00000 | B | 0.186246 | 0.038586 |
| STxAGK | CCcCCH | 4.6 | 0.0 | 7.1 | 23.102876 | 1.3889e−08 | 1.00000 | B | 0.647887 | 0.005519 |

TABLE 31-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| YRxLVV | HCcEEE | 5.0 | 0.1 | 5.0 | 13.214477 | 1.6713e−08 | 1.00000 | B | 1.000000 | 0.027836 |
| GLxDWK | EEcCCC | 5.2 | 0.1 | 9.4 | 16.189053 | 1.7939e−08 | 1.00000 | B | 0.553191 | 0.010670 |
| CGxGGW | CCcCHH | 3.0 | 0.0 | 11.0 | 41.184265 | 1.8299e−08 | 1.00000 | B | 0.272727 | 0.000481 |
| ELxPLR | CCcCCE | 5.7 | 0.2 | 6.0 | 14.252520 | 2.0714e−08 | 1.00000 | B | 0.950000 | 0.025894 |
| GVxKTS | CCcHHH | 6.0 | 0.2 | 20.1 | 13.617286 | 2.1197e−08 | 1.00000 | B | 0.298507 | 0.009159 |
| NGxGKS | CCcCHH | 6.5 | 0.2 | 21.0 | 13.915816 | 2.2105e−08 | 1.00000 | B | 0.309524 | 0.009836 |
| IYxDRL | EEcCEE | 3.0 | 0.0 | 4.0 | 35.222300 | 2.3615e−08 | 1.00000 | B | 0.750000 | 0.001808 |

TABLE 32

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STKxxK | CEEeeE | 60.5 | 11.8 | 226.5 | 14.522757 | 3.7939e−47 | 1.00000 | N | 0.267108 | 0.052292 |
| EVIxxW | CCChhH | 22.8 | 0.2 | 22.5 | 53.968344 | 7.7380e−47 | 1.00000 | B | 1.013333 | 0.007666 |
| VACxxG | ECCccC | 33.4 | 1.2 | 47.1 | 29.574227 | 6.3139e−42 | 1.00000 | B | 0.709130 | 0.025811 |
| GSGxxT | CCChhH | 36.1 | 1.7 | 102.2 | 26.408632 | 2.3179e−37 | 1.00000 | B | 0.353229 | 0.016864 |
| TQTxxT | CCCchH | 18.0 | 0.3 | 17.0 | 33.543696 | 8.6327e−32 | 1.00000 | B | 1.058824 | 0.014884 |
| TKVxxK | EEEeeE | 66.0 | 18.9 | 393.0 | 11.088342 | 2.6474e−28 | 1.00000 | N | 0.167939 | 0.048171 |
| CSAxxG | CCCccH | 11.6 | 0.0 | 33.2 | 68.884804 | 1.3944e−26 | 1.00000 | B | 0.349398 | 0.000851 |
| PTVVxxG | CEEccC | 14.5 | 0.2 | 12.5 | 30.902724 | 4.3313e−23 | 1.00000 | B | 1.160000 | 0.012920 |
| SAGxxR | CCCchH | 13.2 | 0.2 | 48.1 | 33.084486 | 6.2790e−22 | 1.00000 | B | 0.274428 | 0.003242 |
| QSPxxL | EECceE | 30.2 | 6.3 | 250.7 | 9.604652 | 2.6407e−21 | 1.00000 | N | 0.120463 | 0.025266 |
| YASxxT | HHCccC | 19.3 | 1.0 | 33.0 | 18.515875 | 6.1353e−21 | 1.00000 | B | 0.584848 | 0.030509 |
| AAGxxT | CCChhH | 13.1 | 0.3 | 27.3 | 25.583799 | 7.7444e−20 | 1.00000 | B | 0.479853 | 0.009321 |
| GLGxxI | ECCeeE | 9.7 | 0.1 | 10.7 | 35.901749 | 3.0417e−19 | 1.00000 | B | 0.906542 | 0.006767 |
| SSTxxD | HCEeeE | 40.2 | 11.4 | 216.6 | 8.739729 | 4.4322e−18 | 1.00000 | N | 0.185596 | 0.052797 |
| PGHxxL | CCHhhC | 11.7 | 0.3 | 13.0 | 21.216128 | 1.9065e−17 | 1.00000 | B | 0.900000 | 0.022743 |
| NTKxxK | CEEeeE | 29.8 | 7.3 | 135.5 | 8.590840 | 2.2286e−17 | 1.00000 | N | 0.219926 | 0.053643 |
| ACNxxS | CCCccC | 7.0 | 0.0 | 7.0 | 38.909066 | 4.3747e−17 | 1.00000 | B | 1.000000 | 0.004602 |
| FHIxxI | HCCccE | 1.8 | 0.0 | 1.0 | 5.653955 | 1.0765e−16 | 1.00000 | B | 1.800000 | 0.030333 |
| ADKxxP | EECccC | 1.7 | 0.0 | 1.0 | 5.727191 | 1.0774e−16 | 1.00000 | B | 1.700000 | 0.029585 |
| WGDxxI | CCHhhH | 1.0 | 0.0 | 1.0 | 6.949056 | 1.0877e−16 | 1.00000 | B | 1.000000 | 0.020288 |
| GVGxxS | CCChhH | 14.0 | 0.6 | 56.6 | 17.201557 | 1.3442e−15 | 1.00000 | B | 0.247350 | 0.010819 |
| NPTxxE | CCChhH | 24.1 | 3.0 | 87.4 | 12.312848 | 1.9262e−15 | 1.00000 | B | 0.275744 | 0.034700 |
| TGTxxT | CCCchH | 12.0 | 0.4 | 22.8 | 17.764571 | 2.0846e−15 | 1.00000 | B | 0.526316 | 0.018957 |
| CKNxxT | CCCccC | 16.8 | 1.2 | 47.7 | 14.763650 | 3.0318e−15 | 1.00000 | B | 0.352201 | 0.024136 |
| CSAxxG | CCCccC | 10.0 | 0.2 | 26.4 | 22.084450 | 3.3022e−15 | 1.00000 | B | 0.378788 | 0.007518 |
| SWGxxC | EECccC | 15.5 | 0.8 | 138.2 | 16.002815 | 7.0489e−15 | 1.00000 | B | 0.112156 | 0.006107 |
| NAGxxT | CCChhH | 9.3 | 0.2 | 15.7 | 22.744011 | 8.3544e−15 | 1.00000 | B | 0.592357 | 0.010387 |
| GAGxxT | CCChhH | 18.9 | 1.7 | 76.7 | 13.170310 | 1.7157e−14 | 1.00000 | B | 0.246415 | 0.022653 |
| GVGxxA | CCChhH | 14.4 | 0.8 | 63.0 | 15.725470 | 1.8748e−14 | 1.00000 | B | 0.228571 | 0.012086 |
| ATNxxV | CCChhH | 8.3 | 0.2 | 8.4 | 20.963833 | 2.3520e−14 | 1.00000 | B | 0.988095 | 0.018311 |
| FPGxxA | CCChhH | 11.6 | 0.4 | 23.0 | 17.674124 | 2.5125e−14 | 1.00000 | B | 0.504348 | 0.017749 |
| SSTxxT | CCCchH | 7.0 | 0.1 | 7.1 | 23.407247 | 5.9084e−14 | 1.00000 | B | 0.985915 | 0.012435 |
| TVAxxE | CHHhhH | 14.8 | 1.1 | 24.2 | 13.272042 | 6.4829e−14 | 1.00000 | B | 0.611570 | 0.046058 |
| FTVxxN | CCHhhH | 9.0 | 0.2 | 11.6 | 17.712530 | 1.2155e−13 | 1.00000 | B | 0.775862 | 0.021503 |
| SAGxxR | CCCccH | 8.5 | 0.1 | 23.1 | 23.814209 | 1.6932e−13 | 1.00000 | B | 0.367965 | 0.005384 |
| VSWxxG | EEEEccC | 13.7 | 0.7 | 132.3 | 15.493865 | 1.7679e−13 | 1.00000 | B | 0.103553 | 0.005344 |
| CEGxxY | EECccC | 15.0 | 1.2 | 45.9 | 13.040250 | 2.4547e−13 | 1.00000 | B | 0.326797 | 0.025189 |
| QTGxxK | CCCccH | 12.2 | 0.6 | 38.8 | 15.210328 | 3.1614e−13 | 1.00000 | B | 0.314433 | 0.015245 |
| DNAxxT | CCCchH | 9.3 | 0.3 | 13.9 | 17.499545 | 4.8409e−13 | 1.00000 | B | 0.669065 | 0.019531 |
| NWGxxV | CHHhhH | 7.3 | 0.1 | 21.0 | 26.559055 | 5.4139e−13 | 1.00000 | B | 0.347619 | 0.003537 |
| SCQxxS | CCCccC | 9.4 | 0.2 | 76.8 | 19.969066 | 7.6050e−13 | 1.00000 | B | 0.122396 | 0.002764 |
| KETxxA | CCChhH | 18.8 | 2.4 | 45.1 | 10.948289 | 1.1586e−12 | 1.00000 | B | 0.416851 | 0.052675 |
| NYTxxL | CCCccC | 10.1 | 0.4 | 33.0 | 16.312844 | 1.6032e−12 | 1.00000 | B | 0.306061 | 0.010921 |
| CLGxxC | ECCccC | 6.5 | 0.1 | 10.0 | 28.012557 | 2.3569e−12 | 1.00000 | B | 0.650000 | 0.005325 |
| SGVxxS | CCCchH | 13.3 | 0.9 | 37.9 | 12.867366 | 3.0001e−12 | 1.00000 | B | 0.350923 | 0.024946 |
| GYSxxN | CEChhH | 13.0 | 0.9 | 42.3 | 12.842946 | 3.1635e−12 | 1.00000 | B | 0.307329 | 0.021422 |
| LDNxxK | CCCccH | 7.3 | 0.1 | 11.5 | 20.759587 | 4.9463e−12 | 1.00000 | B | 0.634783 | 0.010510 |
| RIVxxT | EECccC | 8.8 | 0.2 | 24.1 | 18.473092 | 6.3694e−12 | 1.00000 | B | 0.365145 | 0.009037 |
| DAAxxT | CCCchH | 9.0 | 0.3 | 18.0 | 15.524576 | 7.1271e−12 | 1.00000 | B | 0.500000 | 0.017686 |
| GTGxxF | CCChhH | 8.0 | 0.2 | 12.8 | 16.646189 | 8.2070e−12 | 1.00000 | B | 0.625000 | 0.017357 |
| LGNxxR | CCCccH | 5.5 | 0.0 | 10.3 | 33.262540 | 1.9184e−11 | 1.00000 | B | 0.533981 | 0.002635 |
| HLCxxH | CCCchH | 9.8 | 0.5 | 14.2 | 13.568130 | 2.9460e−11 | 1.00000 | B | 0.690141 | 0.034352 |
| NQTxxR | HHChhH | 12.9 | 1.0 | 46.4 | 12.053151 | 3.2314e−11 | 1.00000 | B | 0.278017 | 0.021481 |
| IVNxxP | ECCccC | 10.3 | 0.6 | 22.0 | 13.083925 | 4.5307e−11 | 1.00000 | B | 0.468182 | 0.025815 |
| SPGxxR | CCCceE | 8.0 | 0.3 | 14.9 | 14.892055 | 7.0207e−11 | 1.00000 | B | 0.536913 | 0.018402 |
| QGSxxT | CCCchH | 6.2 | 0.1 | 11.9 | 20.206649 | 1.4310e−10 | 1.00000 | B | 0.521008 | 0.007738 |
| MELxxL | EECccC | 7.0 | 0.2 | 10.2 | 14.733553 | 2.7272e−10 | 1.00000 | B | 0.686275 | 0.021233 |
| NVGxxS | CCChhH | 8.5 | 0.4 | 12.5 | 13.078561 | 3.7104e−10 | 1.00000 | B | 0.680000 | 0.031719 |
| ENDxxG | CCChhH | 8.6 | 0.4 | 12.7 | 13.047740 | 3.9246e−10 | 1.00000 | B | 0.677165 | 0.032073 |
| GIPxxQ | CCChhH | 17.9 | 2.9 | 69.3 | 8.960881 | 6.8872e−10 | 1.00000 | B | 0.258297 | 0.042109 |
| KTTxxY | HHHhhH | 10.0 | 0.7 | 37.4 | 11.632848 | 7.0627e−10 | 1.00000 | B | 0.267380 | 0.017557 |

TABLE 32-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| FPExxT | HHHhhH | 14.2 | 1.7 | 58.9 | 9.754512 | 8.2132e-10 | 1.00000 | B | 0.241087 | 0.028739 |
| TGDxxG | ECCccC | 7.1 | 0.2 | 30.0 | 14.821104 | 1.6564e-09 | 1.00000 | B | 0.236667 | 0.007241 |
| DACxxD | ECCccC | 4.1 | 0.0 | 61.8 | 33.257720 | 1.7419e-09 | 1.00000 | B | 0.066343 | 0.000244 |
| GISxxT | CCChhH | 10.1 | 0.8 | 22.8 | 10.488750 | 2.0178e-09 | 1.00000 | B | 0.442982 | 0.035657 |
| NMDxxE | CCChhH | 12.4 | 1.4 | 28.5 | 9.575028 | 2.1163e-09 | 1.00000 | B | 0.435088 | 0.048771 |
| TQSxxS | EEEccE | 21.5 | 6.4 | 177.4 | 6.065732 | 2.2502e-09 | 1.00000 | N | 0.121195 | 0.036167 |
| GLSxxI | EEEccC | 3.0 | 0.0 | 5.0 | 53.996155 | 2.3408e-09 | 1.00000 | B | 0.600000 | 0.000616 |
| SESxxH | CCHhhH | 3.5 | 0.0 | 5.0 | 50.186716 | 4.5726e-09 | 1.00000 | B | 0.700000 | 0.000971 |
| GHGxxT | CCChhH | 6.0 | 0.2 | 6.1 | 11.911470 | 5.0834e-09 | 1.00000 | B | 0.983607 | 0.039881 |
| NVAxxN | EECccC | 14.3 | 2.1 | 45.9 | 8.718869 | 5.9217e-09 | 1.00000 | B | 0.311547 | 0.044938 |
| ACQxxS | CCCccC | 6.0 | 0.1 | 28.6 | 15.550736 | 6.0423e-09 | 1.00000 | B | 0.209790 | 0.004986 |
| PSGxxK | CCCccH | 8.5 | 0.5 | 28.6 | 11.946646 | 6.5585e-09 | 1.00000 | B | 0.297203 | 0.016094 |
| GQGxxS | CCChhH | 7.0 | 0.3 | 11.0 | 11.597337 | 8.0172e-09 | 1.00000 | B | 0.636364 | 0.030935 |
| DGGxxS | CCCccC | 9.0 | 0.6 | 37.0 | 10.714724 | 8.6960e-09 | 1.00000 | B | 0.243243 | 0.016807 |
| FQLxxE | CCCchH | 6.9 | 0.2 | 21.0 | 14.135162 | 8.7273e-09 | 1.00000 | B | 0.328571 | 0.010733 |
| TGDxxC | CCChhH | 5.0 | 0.1 | 12.5 | 17.750741 | 8.8848e-09 | 1.00000 | B | 0.400000 | 0.006191 |
| NSGxxT | CCChhH | 6.5 | 0.2 | 10.0 | 13.493999 | 1.1601e-08 | 1.00000 | B | 0.650000 | 0.022140 |
| HHMxxP | EEEecC | 4.4 | 0.0 | 8.9 | 24.318590 | 1.2380e-08 | 1.00000 | B | 0.494382 | 0.003638 |
| EFDxxD | EEChhH | 5.4 | 0.1 | 18.0 | 18.084978 | 1.2762e-08 | 1.00000 | B | 0.300000 | 0.004819 |
| SCKxxT | CCCeeE | 11.1 | 1.2 | 35.0 | 9.075284 | 1.6971e-08 | 1.00000 | B | 0.317143 | 0.035046 |
| FSTxxR | CHHhhH | 9.5 | 0.9 | 16.7 | 9.595533 | 1.7168e-08 | 1.00000 | B | 0.568862 | 0.051223 |
| RETxxS | EECccC | 11.3 | 1.2 | 48.0 | 9.214567 | 2.0687e-08 | 1.00000 | B | 0.235417 | 0.025551 |
| QGGxxG | CCCchH | 5.5 | 0.1 | 5.2 | 13.445268 | 2.0902e-08 | 1.00000 | B | 1.057692 | 0.027961 |
| VTCxxG | ECCccC | 7.2 | 0.4 | 13.5 | 11.251571 | 2.2708e-08 | 1.00000 | B | 0.533333 | 0.028014 |
| PNRxxR | HHHhhH | 12.2 | 1.5 | 48.9 | 8.713379 | 2.4346e-08 | 1.00000 | B | 0.249489 | 0.031581 |
| KNVxxK | EEEccC | 13.7 | 2.1 | 42.0 | 8.219845 | 2.9154e-08 | 1.00000 | B | 0.326190 | 0.049934 |
| KELxxY | HHHccC | 6.5 | 0.3 | 7.9 | 11.718695 | 2.9653e-08 | 1.00000 | B | 0.822785 | 0.036891 |
| KCKxxH | HCCccC | 5.0 | 0.1 | 6.1 | 13.620436 | 3.0526e-08 | 1.00000 | B | 0.819672 | 0.021411 |
| IYRxxL | EECceE | 3.0 | 0.0 | 4.0 | 33.544899 | 3.1613e-08 | 1.00000 | B | 0.750000 | 0.001993 |
| STVxxT | EEEeeE | 11.4 | 1.4 | 30.4 | 8.710677 | 3.1635e-08 | 1.00000 | B | 0.375000 | 0.045559 |
| SAAxxR | CHHhhH | 17.5 | 3.5 | 71.0 | 7.613866 | 3.2381e-08 | 1.00000 | B | 0.246479 | 0.049841 |
| GFSxxD | CCChhH | 10.6 | 1.1 | 34.6 | 9.262979 | 3.3221e-08 | 1.00000 | B | 0.306358 | 0.031463 |
| QPGxxQ | CCHhhH | 5.5 | 0.1 | 6.9 | 14.348240 | 3.4235e-08 | 1.00000 | B | 0.797101 | 0.020633 |
| EYAxxG | CCCccC | 8.2 | 0.6 | 21.4 | 10.124027 | 4.2668e-08 | 1.00000 | B | 0.383178 | 0.027198 |
| QHFxxL | EEEecE | 6.7 | 0.2 | 5.8 | 12.664366 | 4.4726e-08 | 1.00000 | B | 1.155172 | 0.034901 |
| PNGxxK | CCCccH | 7.0 | 0.4 | 21.1 | 11.085149 | 4.4894e-08 | 1.00000 | B | 0.331754 | 0.017280 |
| PTExxL | CCHhhH | 11.2 | 1.3 | 78.3 | 8.925828 | 4.6189e-08 | 1.00000 | B | 0.143040 | 0.016096 |
| PSSxxA | CCEeeE | 14.1 | 2.2 | 99.1 | 8.057665 | 4.7806e-08 | 1.00000 | B | 0.142281 | 0.022428 |

TABLE 33

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STKxDK | CEEeEE | 55.6 | 8.7 | 226.6 | 16.255923 | 1.6857e-58 | 1.00000 | N | 0.245366 | 0.038248 |
| TKVxKK | EEEeEE | 65.1 | 13.0 | 336.5 | 14.736016 | 1.5202e-48 | 1.00000 | N | 0.193462 | 0.038638 |
| SAGxGR | CCCcHH | 13.2 | 0.0 | 46.1 | 75.771959 | 3.4177e-31 | 1.00000 | B | 0.286334 | 0.000656 |
| SSTxVD | HCEeEE | 39.7 | 8.3 | 215.6 | 11.142764 | 2.7999e-28 | 1.00000 | N | 0.184137 | 0.038369 |
| CSAxIG | CCCcCC | 8.5 | 0.0 | 11.9 | 146.471121 | 9.1438e-27 | 1.00000 | B | 0.714286 | 0.000283 |
| TQTxKT | CCCcHH | 15.3 | 0.2 | 14.3 | 31.603282 | 2.1665e-26 | 1.00000 | B | 1.069930 | 0.014116 |
| GSGxST | CCChHH | 17.9 | 0.4 | 44.9 | 28.229499 | 7.9074e-25 | 1.00000 | B | 0.398664 | 0.008645 |
| NTKxDK | CEEeEE | 28.8 | 5.3 | 135.4 | 10.419284 | 1.0158e-24 | 1.00000 | N | 0.212703 | 0.039113 |
| VACxNG | ECCcCC | 21.6 | 1.0 | 44.0 | 21.151067 | 8.7514e-24 | 1.00000 | B | 0.490909 | 0.022104 |
| YASxRT | HHCcCC | 17.3 | 0.7 | 30.0 | 20.226529 | 9.0033e-21 | 1.00000 | B | 0.576667 | 0.023008 |
| CSAxVG | CCCcCH | 6.8 | 0.0 | 16.0 | 121.887300 | 8.6362e-20 | 1.00000 | B | 0.425000 | 0.000194 |
| TGTxKT | CCCcHH | 12.0 | 0.2 | 20.8 | 25.525015 | 3.4833e-19 | 1.00000 | B | 0.576923 | 0.010355 |
| SAGxGR | CCCcCH | 8.5 | 0.0 | 21.6 | 52.240844 | 6.4657e-19 | 1.00000 | B | 0.393519 | 0.001271 |
| NAGxTT | CCChHH | 9.3 | 0.1 | 13.9 | 31.221526 | 1.9447e-17 | 1.00000 | B | 0.669065 | 0.006303 |
| PTVVxIG | CEEcCC | 12.3 | 0.1 | 9.3 | 25.790761 | 2.7631e-17 | 1.00000 | B | 1.322581 | 0.013789 |
| HIAxVA | EEEeCC | 3.0 | 0.0 | 1.0 | 5.254133 | 1.0714e-16 | 1.00000 | B | 3.000000 | 0.034958 |
| DASxNT | CCEhHH | 1.0 | 0.0 | 1.0 | 6.224344 | 1.0823e-16 | 1.00000 | B | 1.000000 | 0.025162 |
| GTMxPV | CCCcCE | 1.7 | 0.0 | 1.0 | 6.428880 | 1.0840e-16 | 1.00000 | B | 1.700000 | 0.023624 |
| GPExSF | CHHhCC | 1.0 | 0.0 | 1.0 | 7.872524 | 1.0926e-16 | 1.00000 | B | 1.000000 | 0.015879 |
| GYRxNG | CCEeEE | 1.0 | 0.0 | 1.0 | 18.626022 | 1.1070e-16 | 1.00000 | B | 1.000000 | 0.002874 |
| DNAxKT | CCCcHH | 9.3 | 0.1 | 13.1 | 27.283943 | 1.5916e-16 | 1.00000 | B | 0.709924 | 0.008729 |
| CLGxIC | ECCcCC | 6.0 | 0.0 | 9.0 | 53.549510 | 6.0640e-16 | 1.00000 | B | 0.666667 | 0.001391 |
| LDNxGK | CCCcCH | 7.3 | 0.0 | 11.5 | 38.694812 | 9.3203e-16 | 1.00000 | B | 0.634783 | 0.003074 |
| AAGxTT | CCChHH | 9.0 | 0.1 | 18.0 | 25.941783 | 1.0307e-15 | 1.00000 | B | 0.500000 | 0.006556 |
| SWGxGC | EECcCC | 15.3 | 0.7 | 129.4 | 17.090125 | 1.1583e-15 | 1.00000 | B | 0.118238 | 0.005648 |
| GVGxSA | CCChHH | 12.4 | 0.4 | 45.9 | 19.796606 | 1.4383e-15 | 1.00000 | B | 0.270153 | 0.008108 |
| DAAxKT | CCCcHH | 9.0 | 0.2 | 18.0 | 22.774382 | 1.0039e-14 | 1.00000 | B | 0.500000 | 0.008457 |
| IVNxTP | ECCcCC | 9.3 | 0.2 | 22.0 | 22.913053 | 1.8558e-14 | 1.00000 | B | 0.422727 | 0.007285 |
| PGHxAL | CCHhHC | 9.9 | 0.2 | 12.9 | 19.649495 | 2.1377e-14 | 1.00000 | B | 0.767442 | 0.019076 |
| LGNxCR | CCCcCH | 5.5 | 0.0 | 10.3 | 63.590565 | 3.0404e-14 | 1.00000 | B | 0.533981 | 0.000725 |

TABLE 33-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| ACNxDS | CCCcCC | 5.0 | 0.0 | 6.0 | 51.992620 | 5.1575e-14 | 1.00000 | B | 0.833333 | 0.001538 |
| CSAxIG | CCCcCH | 4.8 | 0.0 | 9.7 | 99.533355 | 1.1954e-13 | 1.00000 | B | 0.494845 | 0.000240 |
| SGVxKS | CCCcHH | 11.3 | 0.4 | 32.3 | 16.917556 | 1.4040e-13 | 1.00000 | B | 0.349845 | 0.012975 |
| GTGxTF | CCChHH | 8.0 | 0.2 | 9.8 | 19.427452 | 2.1554e-13 | 1.00000 | B | 0.816327 | 0.016880 |
| QTGxGK | CCCcCH | 11.5 | 0.5 | 36.8 | 16.466361 | 3.1892e-13 | 1.00000 | B | 0.312500 | 0.012378 |
| DGGxGK | CCCcCH | 9.0 | 0.2 | 36.0 | 19.638787 | 4.4953e-13 | 1.00000 | B | 0.250000 | 0.005607 |
| QGSxKT | CCCcHH | 6.2 | 0.0 | 11.9 | 32.654707 | 5.0082e-13 | 1.00000 | B | 0.521008 | 0.003004 |
| GSGxTT | CCChHH | 11.2 | 0.5 | 31.1 | 15.166466 | 1.1005e-12 | 1.00000 | B | 0.360129 | 0.016252 |
| GAGxTT | CCChHH | 9.0 | 0.3 | 16.9 | 17.041702 | 1.2312e-12 | 1.00000 | B | 0.532544 | 0.015789 |
| GVGxSS | CCChHH | 8.0 | 0.2 | 18.0 | 19.581495 | 1.7118e-12 | 1.00000 | B | 0.444444 | 0.008983 |
| QSPxSL | EECcEE | 25.0 | 4.4 | 183.2 | 10.018045 | 2.8037e-12 | 1.00000 | B | 0.136463 | 0.023753 |
| SSTxNT | CCCcHH | 7.0 | 0.1 | 6.0 | 21.807312 | 3.7412e-12 | 1.00000 | B | 1.166667 | 0.012460 |
| RIVxYT | EECcCC | 8.8 | 0.2 | 23.1 | 18.925367 | 4.1481e-12 | 1.00000 | B | 0.380952 | 0.009004 |
| PSGxGK | CCCcCH | 8.0 | 0.2 | 28.7 | 19.269802 | 4.4409e-12 | 1.00000 | B | 0.278746 | 0.005792 |
| PNGxGK | CCCcCH | 7.0 | 0.1 | 21.1 | 21.242037 | 9.0973e-12 | 1.00000 | B | 0.331754 | 0.005017 |
| KNVxCK | EEEcCC | 13.7 | 1.1 | 42.0 | 12.273416 | 9.7008e-12 | 1.00000 | B | 0.326190 | 0.025822 |
| GAGxTS | CCChHH | 4.6 | 0.0 | 6.0 | 55.188706 | 1.0692e-11 | 1.00000 | B | 0.766667 | 0.001156 |
| AKRxNF | CCCcCE | 7.3 | 0.1 | 18.3 | 20.637253 | 1.3947e-11 | 1.00000 | B | 0.398907 | 0.006655 |
| NQTxNR | HHChHH | 12.8 | 0.9 | 46.4 | 12.691651 | 1.5524e-11 | 1.00000 | B | 0.275862 | 0.019330 |
| VSWxRG | EEEcCC | 4.3 | 0.0 | 5.3 | 50.560978 | 1.7337e-11 | 1.00000 | B | 0.811321 | 0.001362 |
| GLGxSI | ECCeEE | 5.5 | 0.0 | 6.2 | 29.505444 | 2.1111e-11 | 1.00000 | B | 0.887097 | 0.005565 |
| ATNxRV | CCChHH | 8.3 | 0.1 | 6.4 | 20.022828 | 2.1648e-11 | 1.00000 | B | 1.296875 | 0.015713 |
| FPExLT | HHHhHH | 14.2 | 1.3 | 57.9 | 11.378309 | 2.9795e-11 | 1.00000 | B | 0.245250 | 0.022670 |
| GVGxSN | CCChHH | 6.3 | 0.1 | 12.0 | 21.969649 | 5.7852e-11 | 1.00000 | B | 0.525000 | 0.006723 |
| MELxTL | EECcCC | 7.0 | 0.2 | 9.1 | 15.541949 | 8.4461e-11 | 1.00000 | B | 0.769231 | 0.021525 |
| LGFxIV | CCEeEE | 4.3 | 0.0 | 7.8 | 38.805376 | 2.5905e-10 | 1.00000 | B | 0.551282 | 0.001568 |
| GQGxMS | CCChHH | 5.0 | 0.1 | 5.0 | 19.958451 | 2.9275e-10 | 1.00000 | B | 1.000000 | 0.012396 |
| QGGxIM | CCCcHH | 4.8 | 0.0 | 5.0 | 29.497827 | 7.6876e-10 | 1.00000 | B | 0.960000 | 0.005266 |
| LNVxMV | CEEeEE | 3.3 | 0.0 | 5.0 | 64.224084 | 1.0266e-09 | 1.00000 | B | 0.660000 | 0.000527 |
| DACxGD | ECCcCC | 4.1 | 0.0 | 61.8 | 35.388383 | 1.0648e-09 | 1.00000 | B | 0.066343 | 0.000216 |
| NVAxKN | EECcCC | 13.3 | 1.5 | 43.0 | 9.703826 | 1.3782e-09 | 1.00000 | B | 0.309302 | 0.035495 |
| GLSxLI | EEEcCC | 3.0 | 0.0 | 3.0 | 50.949375 | 1.5382e-09 | 1.00000 | B | 1.000000 | 0.001154 |
| TVAxNE | CHHhHH | 7.8 | 0.4 | 10.6 | 12.570650 | 2.3379e-09 | 1.00000 | B | 0.735849 | 0.034194 |
| QCGxCW | CCEcHH | 4.2 | 0.0 | 9.5 | 29.808739 | 2.4093e-09 | 1.00000 | B | 0.442105 | 0.002074 |
| WGHxYA | CCCcHH | 5.0 | 0.0 | 4.0 | 23.565216 | 2.6158e-09 | 1.00000 | B | 1.250000 | 0.007152 |
| WKNxFT | HHHcCC | 5.9 | 0.1 | 8.6 | 17.818038 | 2.8442e-09 | 1.00000 | B | 0.686047 | 0.012446 |
| DSGxGK | CCCcCH | 8.3 | 0.4 | 37.5 | 12.773489 | 3.0722e-09 | 1.00000 | B | 0.221333 | 0.010339 |
| NSGxTT | CCChHH | 6.5 | 0.2 | 9.0 | 14.802534 | 3.1087e-09 | 1.00000 | B | 0.722222 | 0.020643 |
| GGTxKT | CCCcHH | 8.0 | 0.4 | 31.0 | 12.341190 | 3.4938e-09 | 1.00000 | B | 0.258065 | 0.012435 |
| QCGxCW | CCCcHH | 4.8 | 0.0 | 20.2 | 27.916343 | 4.4457e-09 | 1.00000 | B | 0.237624 | 0.001448 |
| VEFxFP | CCCcCC | 8.6 | 0.5 | 14.0 | 11.124863 | 5.3705e-09 | 1.00000 | B | 0.614286 | 0.038960 |
| GSTxEK | CEEeEE | 10.5 | 0.9 | 24.4 | 10.039871 | 5.6240e-09 | 1.00000 | B | 0.430328 | 0.038632 |
| KCKxCH | HCCcCC | 5.0 | 0.1 | 5.6 | 15.673528 | 5.6390e-09 | 1.00000 | B | 0.892857 | 0.017772 |
| EFTxPD | CCCcCC | 8.6 | 0.6 | 14.0 | 11.007189 | 6.2511e-09 | 1.00000 | B | 0.614286 | 0.039724 |
| GGVxKS | CCCcHH | 9.1 | 0.6 | 54.0 | 11.185057 | 6.4450e-09 | 1.00000 | B | 0.168519 | 0.010848 |
| YGFxLH | CCEeEE | 4.0 | 0.0 | 4.0 | 20.720564 | 7.2597e-09 | 1.00000 | B | 1.000000 | 0.009231 |
| GVGxTS | CCChHH | 6.0 | 0.2 | 21.1 | 14.676187 | 9.5090e-09 | 1.00000 | B | 0.284360 | 0.007563 |
| YTPxLP | CCCcCC | 8.0 | 0.5 | 27.6 | 11.206864 | 1.2161e-08 | 1.00000 | B | 0.289855 | 0.016678 |
| VDHxKT | CCCcHH | 6.5 | 0.2 | 27.3 | 14.707293 | 1.4173e-08 | 1.00000 | B | 0.238095 | 0.006798 |
| QRRxLG | CCCcHH | 5.0 | 0.1 | 6.0 | 14.558979 | 1.5132e-08 | 1.00000 | B | 0.833333 | 0.019131 |
| GISxET | CCChHH | 7.6 | 0.4 | 14.2 | 11.660873 | 1.6894e-08 | 1.00000 | B | 0.535211 | 0.027667 |
| DHGxTT | CCChHH | 6.0 | 0.2 | 28.3 | 14.184164 | 1.6909e-08 | 1.00000 | B | 0.212014 | 0.006006 |
| SGSxKS | CCCcHH | 6.7 | 0.2 | 20.8 | 13.652759 | 2.3784e-08 | 1.00000 | B | 0.322115 | 0.010926 |
| HHMxLP | EEEeCC | 3.4 | 0.0 | 8.9 | 40.330625 | 2.4388e-08 | 1.00000 | B | 0.382022 | 0.000796 |
| INGxSA | HHCcHH | 5.0 | 0.2 | 5.0 | 12.702857 | 2.4523e-08 | 1.00000 | B | 1.000000 | 0.030055 |
| AGTxKS | CCChHH | 4.0 | 0.0 | 5.5 | 19.813123 | 2.5620e-08 | 1.00000 | B | 0.727273 | 0.007316 |
| ELGxLR | CCCcCE | 5.7 | 0.2 | 6.5 | 14.233671 | 2.7098e-08 | 1.00000 | B | 0.876923 | 0.023916 |
| TWNxGE | EECcCE | 5.5 | 0.2 | 5.5 | 13.561891 | 2.7523e-08 | 1.00000 | B | 1.000000 | 0.029035 |
| GLTxWK | EECcCC | 5.2 | 0.1 | 9.4 | 15.432176 | 2.8452e-08 | 1.00000 | B | 0.553191 | 0.011710 |
| PLRxFK | CCEeEE | 5.4 | 0.2 | 5.7 | 13.543717 | 3.2325e-08 | 1.00000 | B | 0.947368 | 0.027051 |
| ALDxPD | CCCcCC | 5.5 | 0.2 | 6.0 | 13.792962 | 3.3034e-08 | 1.00000 | B | 0.916667 | 0.025696 |
| RVExTF | CCCcCC | 6.9 | 0.4 | 9.0 | 11.165987 | 3.4462e-08 | 1.00000 | B | 0.766667 | 0.039724 |
| THCxVH | CCEeEE | 5.0 | 0.0 | 3.0 | 29.548453 | 4.0150e-08 | 1.00000 | B | 1.666667 | 0.003424 |
| GSGxGT | CCChHH | 6.0 | 0.2 | 11.8 | 12.122485 | 4.1308e-08 | 1.00000 | B | 0.508475 | 0.019576 |
| LGPxRS | CCCcEE | 5.7 | 0.2 | 6.0 | 13.118801 | 4.6152e-08 | 1.00000 | B | 0.950000 | 0.030406 |
| AAGxST | CCChHH | 4.1 | 0.0 | 6.0 | 18.903444 | 4.7469e-08 | 1.00000 | B | 0.683333 | 0.007724 |
| TLKxET | CCEeEE | 6.0 | 0.3 | 9.0 | 11.359947 | 4.8191e-08 | 1.00000 | B | 0.666667 | 0.029193 |
| PGSxKG | CCCcHH | 5.0 | 0.1 | 10.1 | 14.377506 | 5.2693e-08 | 1.00000 | B | 0.495050 | 0.011555 |
| IYRxRL | EECcEE | 3.0 | 0.0 | 4.0 | 29.281320 | 7.1208e-08 | 1.00000 | B | 0.750000 | 0.002613 |

TABLE 34

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STKVxK | CEEEeE | 58.5 | 9.1 | 226.5 | 16.684990 | 1.4066e-61 | 1.00000 | N | 0.258278 | 0.040286 |
| GSGKxT | CCCHhH | 34.1 | 0.7 | 84.7 | 39.230822 | 1.9681e-47 | 1.00000 | B | 0.402597 | 0.008617 |
| TKVDxK | EEEEeE | 65.5 | 14.0 | 338.5 | 14.091535 | 1.4697e-44 | 1.00000 | N | 0.193501 | 0.041227 |
| VACKxG | ECCCcC | 31.1 | 1.2 | 45.0 | 27.213170 | 4.3643e-38 | 1.00000 | B | 0.691111 | 0.027516 |
| TQTGxT | CCCChH | 18.0 | 0.3 | 17.0 | 33.601240 | 8.1511e-32 | 1.00000 | B | 1.058824 | 0.014834 |
| CSAGxG | CCCCcH | 10.3 | 0.0 | 33.2 | 101.706126 | 5.3781e-28 | 1.00000 | B | 0.310241 | 0.000308 |
| SSTKxD | HCEEeE | 37.9 | 8.0 | 196.6 | 10.787374 | 1.3832e-26 | 1.00000 | N | 0.192777 | 0.040721 |
| AAGKxT | CCCHhH | 13.1 | 0.1 | 24.0 | 44.361614 | 3.6765e-26 | 1.00000 | B | 0.545833 | 0.003599 |
| NTKVxK | CEEEeE | 29.8 | 5.6 | 135.4 | 10.438853 | 7.8103e-25 | 1.00000 | N | 0.220089 | 0.041391 |
| GVGKxS | CCCHhH | 14.0 | 0.1 | 38.0 | 36.367233 | 1.3150e-24 | 1.00000 | B | 0.368421 | 0.003834 |
| FPGHxA | CCCHhH | 10.6 | 0.1 | 13.0 | 38.749603 | 4.1480e-21 | 1.00000 | B | 0.815385 | 0.005708 |
| GAGKxT | CCCHhH | 17.7 | 0.6 | 56.1 | 22.055939 | 8.2545e-21 | 1.00000 | B | 0.315508 | 0.010823 |
| YASGxT | HHCCcC | 17.3 | 0.7 | 30.0 | 19.794775 | 1.7769e-20 | 1.00000 | B | 0.576667 | 0.023963 |
| GVGKxA | CCCHhH | 13.4 | 0.2 | 49.1 | 27.315326 | 8.8595e-20 | 1.00000 | B | 0.272912 | 0.004755 |
| SAGIxR | CCCCcH | 7.5 | 0.0 | 14.7 | 72.680577 | 2.7529e-19 | 1.00000 | B | 0.510204 | 0.000723 |
| PTVVNxG | CEECcC | 13.5 | 0.1 | 10.5 | 27.663655 | 3.7910e-19 | 1.00000 | B | 1.285714 | 0.013535 |
| DNAGxT | CCCChH | 9.3 | 0.1 | 12.9 | 37.638562 | 4.8746e-19 | 1.00000 | B | 0.720930 | 0.004693 |
| CSAGxG | CCCCcC | 7.3 | 0.0 | 18.9 | 67.922555 | 1.0491e-18 | 1.00000 | B | 0.386243 | 0.000610 |
| SAGVxR | CCCChH | 7.3 | 0.0 | 18.1 | 64.671021 | 1.9499e-18 | 1.00000 | B | 0.403315 | 0.000702 |
| VSWGxG | EEECcC | 13.7 | 0.3 | 111.4 | 24.500612 | 3.0198e-18 | 1.00000 | B | 0.122980 | 0.002692 |
| NAGKxT | CCCHhH | 9.3 | 0.1 | 15.7 | 34.798487 | 4.6527e-18 | 1.00000 | B | 0.592357 | 0.004501 |
| GLGFxI | ECCEeE | 7.2 | 0.0 | 7.9 | 39.857265 | 1.0617e-16 | 1.00000 | B | 0.911392 | 0.004110 |
| TGGAxI | CCCCcE | 1.0 | 0.0 | 1.0 | 5.112750 | 1.0693e-16 | 1.00000 | B | 1.000000 | 0.036846 |
| RYTQxN | CCCCcC | 1.0 | 0.0 | 1.0 | 5.439401 | 1.0739e-16 | 1.00000 | B | 1.000000 | 0.032694 |
| SLPTxD | CCCChH | 1.0 | 0.0 | 1.0 | 5.557401 | 1.0754e-16 | 1.00000 | B | 1.000000 | 0.031363 |
| ALASxA | CCCCcC | 1.0 | 0.0 | 1.0 | 5.760690 | 1.0777e-16 | 1.00000 | B | 1.000000 | 0.029252 |
| FHISxI | HCCCcE | 1.8 | 0.0 | 1.0 | 6.089482 | 1.0811e-16 | 1.00000 | B | 1.800000 | 0.026259 |
| ADKLxP | EECCcC | 1.7 | 0.0 | 1.0 | 6.188020 | 1.0820e-16 | 1.00000 | B | 1.700000 | 0.025451 |
| LSERxT | CCHHhH | 1.0 | 0.0 | 1.0 | 6.443344 | 1.0841e-16 | 1.00000 | B | 1.000000 | 0.023520 |
| ELTSxE | HHHHhH | 1.0 | 0.0 | 1.0 | 7.149093 | 1.0889e-16 | 1.00000 | B | 1.000000 | 0.019190 |
| YIKIxA | EECCcC | 1.5 | 0.0 | 1.0 | 7.853465 | 1.0925e-16 | 1.00000 | B | 1.500000 | 0.015955 |
| KSSTxE | ECCCcC | 1.0 | 0.0 | 1.0 | 8.919297 | 1.0964e-16 | 1.00000 | B | 1.000000 | 0.012414 |
| RSLFxE | CCCHhH | 1.0 | 0.0 | 1.0 | 9.393303 | 1.0978e-16 | 1.00000 | B | 1.000000 | 0.011206 |
| DAAGxT | CCCChH | 9.0 | 0.1 | 18.0 | 27.238045 | 4.3773e-16 | 1.00000 | B | 0.500000 | 0.005957 |
| TGTGxT | CCCChH | 12.0 | 0.4 | 20.8 | 18.661705 | 4.5887e-16 | 1.00000 | B | 0.576923 | 0.018954 |
| CKNGxT | CCCCcC | 16.8 | 1.1 | 47.2 | 15.534036 | 7.2121e-16 | 1.00000 | B | 0.355932 | 0.022272 |
| GTGKxF | CCCHhH | 8.0 | 0.1 | 9.8 | 27.402240 | 9.8161e-16 | 1.00000 | B | 0.816327 | 0.008589 |
| ACNGxS | CCCCcC | 7.0 | 0.0 | 6.0 | 40.200001 | 2.5618e-15 | 1.00000 | B | 1.166667 | 0.003699 |
| CLGNxC | ECCCcC | 6.5 | 0.0 | 10.0 | 48.070386 | 3.8149e-15 | 1.00000 | B | 0.650000 | 0.001821 |
| MELCxL | EECCcC | 7.0 | 0.1 | 9.1 | 29.548559 | 1.2860e-14 | 1.00000 | B | 0.769231 | 0.006107 |
| SAGIxR | CCCChH | 5.9 | 0.0 | 20.0 | 61.175162 | 3.3437e-14 | 1.00000 | B | 0.295000 | 0.000464 |
| QTGTxK | CCCCcH | 7.5 | 0.1 | 10.0 | 28.782865 | 3.6338e-14 | 1.00000 | B | 0.750000 | 0.006714 |
| NVACxN | EECCcC | 14.3 | 1.0 | 43.1 | 13.792835 | 2.2413e-13 | 1.00000 | B | 0.331787 | 0.022206 |
| GVGKxN | CCCHhH | 6.3 | 0.0 | 12.0 | 34.262479 | 3.0452e-13 | 1.00000 | B | 0.525000 | 0.002795 |
| GQGIxS | CCCHhH | 7.0 | 0.1 | 7.0 | 20.184497 | 3.9232e-13 | 1.00000 | B | 1.000000 | 0.016891 |
| NWGRxV | CHHHhH | 7.3 | 0.1 | 21.0 | 26.457581 | 5.7051e-13 | 1.00000 | B | 0.347619 | 0.003564 |
| SGVGxS | CCCHhH | 11.3 | 0.5 | 32.4 | 15.771006 | 5.7870e-13 | 1.00000 | B | 0.348765 | 0.014571 |
| TQSPxS | EEECcE | 21.5 | 5.1 | 177.4 | 7.328957 | 6.0144e-13 | 1.00000 | N | 0.121195 | 0.028944 |
| LDNAxK | CCCCcH | 6.3 | 0.0 | 10.5 | 31.123363 | 7.2899e-13 | 1.00000 | B | 0.600000 | 0.003867 |
| RIVNxT | EECCcC | 8.8 | 0.2 | 22.1 | 20.487107 | 1.1508e-12 | 1.00000 | B | 0.398190 | 0.008079 |
| DGGTxK | CCCCcC | 8.0 | 0.2 | 29.0 | 20.047467 | 2.4564e-12 | 1.00000 | B | 0.275862 | 0.005310 |
| SSTGxT | CCCChH | 7.0 | 0.1 | 6.0 | 21.834595 | 3.6862e-12 | 1.00000 | B | 1.166667 | 0.012429 |
| NVGKxS | CCCHhH | 7.5 | 0.1 | 10.0 | 20.522046 | 3.7863e-12 | 1.00000 | B | 0.750000 | 0.013066 |
| NYTPxL | CCCCcC | 10.1 | 0.4 | 32.0 | 15.306066 | 4.9076e-12 | 1.00000 | B | 0.315625 | 0.012696 |
| LGNIxR | CCCCcC | 4.0 | 0.0 | 7.8 | 60.798179 | 5.7878e-12 | 1.00000 | B | 0.512821 | 0.000554 |
| IVNYxP | ECCCcC | 10.3 | 0.5 | 22.0 | 13.766180 | 1.8207e-11 | 1.00000 | B | 0.468182 | 0.023508 |
| NQTPxR | HHCHhH | 12.9 | 1.0 | 46.4 | 12.190145 | 2.5665e-11 | 1.00000 | B | 0.278017 | 0.021060 |
| NSGKxT | CCCHhH | 6.5 | 0.1 | 9.0 | 21.356062 | 4.3860e-11 | 1.00000 | B | 0.722222 | 0.010109 |
| EYAPxG | CCCCcC | 8.2 | 0.3 | 12.3 | 14.874800 | 4.6252e-11 | 1.00000 | B | 0.666667 | 0.023547 |
| FTVAxN | CCHHhH | 7.8 | 0.2 | 10.6 | 16.868395 | 4.6779e-11 | 1.00000 | B | 0.735849 | 0.019497 |
| GTGKxT | CCCHhH | 9.0 | 0.3 | 53.3 | 15.122265 | 4.9805e-11 | 1.00000 | B | 0.168856 | 0.006205 |
| EFTFxD | CCCCcC | 9.7 | 0.6 | 14.0 | 12.314175 | 1.6790e-10 | 1.00000 | B | 0.692857 | 0.040915 |
| GGTGxT | CCCChH | 8.0 | 0.3 | 31.9 | 14.944327 | 2.2386e-10 | 1.00000 | B | 0.250784 | 0.008459 |
| QGSGxT | CCCHhH | 6.2 | 0.1 | 12.0 | 18.460914 | 4.1542e-10 | 1.00000 | B | 0.516667 | 0.009153 |
| DSGVxK | CCCCcH | 8.3 | 0.3 | 35.5 | 14.606079 | 4.2534e-10 | 1.00000 | B | 0.233803 | 0.008518 |
| STVExT | EEEEeE | 11.4 | 1.0 | 24.4 | 10.715271 | 5.4506e-10 | 1.00000 | B | 0.467213 | 0.040350 |
| VDHGxT | CCCChH | 6.5 | 0.1 | 27.3 | 19.290750 | 6.4666e-10 | 1.00000 | B | 0.238095 | 0.004035 |
| SWGRxC | EECCcC | 4.3 | 0.0 | 5.3 | 31.479143 | 7.5680e-10 | 1.00000 | B | 0.811321 | 0.003503 |
| LSGAxK | CCCCcH | 4.0 | 0.0 | 4.9 | 29.310363 | 8.9269e-10 | 1.00000 | B | 0.816327 | 0.003780 |
| KDYRxE | CCCCcC | 8.8 | 0.5 | 15.5 | 12.425669 | 1.0646e-09 | 1.00000 | B | 0.567742 | 0.029933 |
| KNVAxK | EEECcC | 13.7 | 1.6 | 42.0 | 9.724955 | 1.2122e-09 | 1.00000 | B | 0.326190 | 0.038278 |
| SGSGxS | CCCChH | 6.7 | 0.1 | 19.8 | 17.619560 | 1.2663e-09 | 1.00000 | B | 0.338384 | 0.007051 |
| PNGSxK | CCCCcH | 5.0 | 0.1 | 10.1 | 19.647202 | 2.5756e-09 | 1.00000 | B | 0.495050 | 0.006290 |
| EEGGxW | CCCCcE | 5.5 | 0.1 | 9.0 | 19.744546 | 2.6631e-09 | 1.00000 | B | 0.611111 | 0.008456 |
| KCKAxH | HCCCcC | 5.0 | 0.1 | 5.1 | 16.064817 | 2.7922e-09 | 1.00000 | B | 0.980392 | 0.018626 |
| NVGKxT | CCCHhH | 6.0 | 0.1 | 18.0 | 15.931018 | 3.2649e-09 | 1.00000 | B | 0.333333 | 0.007583 |
| LNVGxV | CEEEeE | 3.3 | 0.0 | 7.7 | 51.472587 | 5.1796e-09 | 1.00000 | B | 0.428571 | 0.000533 |

TABLE 34-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GAGKxS | CCCHhH | 4.6 | 0.0 | 10.0 | 26.804049 | 6.0243e−09 | 1.00000 | B | 0.460000 | 0.002916 |
| DKEGxP | HHHCcC | 14.5 | 2.1 | 53.1 | 8.707830 | 7.6359e−09 | 1.00000 | B | 0.273070 | 0.039712 |
| TVAQxE | CHHHhH | 8.3 | 0.5 | 21.0 | 11.382891 | 8.6178e−09 | 1.00000 | B | 0.395238 | 0.022987 |
| VEFTxP | CCCCcC | 8.6 | 0.6 | 14.0 | 10.667799 | 9.7558e−09 | 1.00000 | B | 0.614286 | 0.042052 |
| GHGYxT | CCCHhH | 6.0 | 0.1 | 5.1 | 14.266534 | 9.7778e−09 | 1.00000 | B | 1.176471 | 0.024445 |
| GSTVxK | CEEEeE | 10.5 | 1.0 | 24.4 | 9.702377 | 9.8438e−09 | 1.00000 | B | 0.430328 | 0.040973 |
| SCKQxT | CCCEeE | 10.1 | 0.9 | 32.0 | 9.840061 | 1.0197e−08 | 1.00000 | B | 0.315625 | 0.028110 |
| RETGxS | EECCcC | 11.3 | 1.2 | 48.0 | 9.552671 | 1.1284e−08 | 1.00000 | B | 0.235417 | 0.024074 |
| NGSGxS | CCCChH | 5.0 | 0.1 | 13.1 | 17.153749 | 1.2945e−08 | 1.00000 | B | 0.381679 | 0.006313 |
| HHMExP | EEEEcC | 4.4 | 0.0 | 8.9 | 23.470902 | 1.6376e−08 | 1.00000 | B | 0.494382 | 0.003902 |
| DHGKxT | CCCHhH | 6.0 | 0.2 | 31.9 | 14.277130 | 1.6708e−08 | 1.00000 | B | 0.188088 | 0.005259 |
| SPGAxR | CCCCeE | 6.0 | 0.2 | 10.9 | 12.858950 | 1.8510e−08 | 1.00000 | B | 0.550459 | 0.018981 |
| ACIAxE | CCCCcC | 6.3 | 0.3 | 7.0 | 11.516135 | 2.1334e−08 | 1.00000 | B | 0.900000 | 0.040631 |
| ELGPxR | CCCCcE | 5.7 | 0.2 | 6.0 | 14.099971 | 2.2990e−08 | 1.00000 | B | 0.950000 | 0.026441 |
| QHFKxL | EEEEcE | 6.7 | 0.2 | 5.8 | 13.135377 | 3.1489e−08 | 1.00000 | B | 1.155172 | 0.032522 |
| DLEAxG | EEEEcC | 2.2 | 0.0 | 4.0 | 119.847863 | 3.4045e−08 | 1.00000 | B | 0.550000 | 0.000084 |
| RSFKxF | EEEEeE | 5.4 | 0.2 | 5.7 | 13.424145 | 3.5216e−08 | 1.00000 | B | 0.947368 | 0.027520 |
| SVGKxS | CCCHhH | 4.0 | 0.0 | 13.0 | 21.268702 | 3.6221e−08 | 1.00000 | B | 0.307692 | 0.002681 |
| IYRDxL | EECCeE | 3.0 | 0.0 | 4.0 | 32.585874 | 3.7597e−08 | 1.00000 | B | 0.750000 | 0.002112 |
| PNVGxS | CCCCxH | 6.0 | 0.2 | 19.4 | 12.859611 | 3.8924e−08 | 1.00000 | B | 0.309278 | 0.010579 |
| GTGKxC | CCCHhH | 4.0 | 0.0 | 6.1 | 18.981083 | 4.3099e−08 | 1.00000 | B | 0.655738 | 0.007173 |
| GPLRxF | CCCEeE | 5.5 | 0.2 | 5.8 | 13.124718 | 4.6797e−08 | 1.00000 | B | 0.948276 | 0.029294 |

TABLE 35

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| STKVDK | CEEEEE | 54.6 | 7.3 | 226.6 | 17.814795 | 7.7075e−70 | 1.00000 | N | 0.240953 | 0.032161 |
| TKVDKK | EEEEEE | 65.1 | 11.0 | 336.5 | 16.615803 | 3.4212e−61 | 1.00000 | N | 0.193462 | 0.032601 |
| SSTKVD | HCEEEE | 37.4 | 6.3 | 196.6 | 12.532954 | 3.0773e−35 | 1.00000 | N | 0.190234 | 0.032272 |
| GSGKST | CCCHHH | 17.9 | 0.2 | 43.8 | 38.350752 | 2.9572e−29 | 1.00000 | B | 0.408676 | 0.004880 |
| TQTGKT | CCCCHH | 15.3 | 0.2 | 14.3 | 32.174467 | 1.3214e−26 | 1.00000 | B | 1.069930 | 0.013626 |
| SAGIGR | CCCCCH | 7.5 | 0.0 | 14.7 | 117.545793 | 3.3253e−22 | 1.00000 | B | 0.510204 | 0.000277 |
| VACKNG | ECCCCC | 20.6 | 1.0 | 43.0 | 19.828434 | 5.1410e−22 | 1.00000 | B | 0.479070 | 0.023263 |
| YASGRT | HHCCCC | 17.3 | 0.6 | 30.0 | 22.109277 | 5.3354e−22 | 1.00000 | B | 0.576667 | 0.019434 |
| SAGVGR | CCCCHH | 7.3 | 0.0 | 18.1 | 109.112108 | 1.3092e−21 | 1.00000 | B | 0.403315 | 0.000247 |
| DNAGKT | CCCHHH | 9.3 | 0.0 | 12.9 | 47.146776 | 8.7394e−21 | 1.00000 | B | 0.720930 | 0.003000 |
| NAGKTT | CCCHHH | 9.3 | 0.0 | 13.9 | 46.853654 | 1.4104e−20 | 1.00000 | B | 0.669065 | 0.002819 |
| CSAGIG | CCCCCC | 6.3 | 0.0 | 11.9 | 123.156446 | 6.8159e−20 | 1.00000 | B | 0.529412 | 0.000220 |
| GVGKSA | CCCHHH | 12.4 | 0.2 | 44.0 | 28.043320 | 4.8288e−19 | 1.00000 | B | 0.281818 | 0.004327 |
| TGTGKT | CCCHHH | 12.0 | 0.2 | 19.8 | 24.719102 | 5.6749e−19 | 1.00000 | B | 0.606061 | 0.011586 |
| AAGKTT | CCCHHH | 9.0 | 0.1 | 18.0 | 37.604373 | 1.4562e−18 | 1.00000 | B | 0.500000 | 0.003152 |
| DAAGKT | CCCHHH | 9.0 | 0.1 | 18.0 | 35.241267 | 4.6128e−18 | 1.00000 | B | 0.500000 | 0.003584 |
| CLGNIC | ECCCCC | 6.0 | 0.0 | 9.0 | 78.058006 | 6.6601e−18 | 1.00000 | B | 0.666667 | 0.000656 |
| GTDVVG | CCCHHH | 2.0 | 0.0 | 2.0 | 11.083550 | 7.0003e−18 | 1.00000 | B | 1.000000 | 0.016020 |
| PTVVNIG | CEECCC | 12.3 | 0.1 | 9.3 | 26.586731 | 1.6109e−17 | 1.00000 | B | 1.322581 | 0.012986 |
| CSAGVG | CCCCCH | 5.8 | 0.0 | 16.0 | 124.248581 | 4.0798e−17 | 1.00000 | B | 0.362500 | 0.000136 |
| HIASVA | EEEECC | 3.0 | 0.0 | 1.0 | 5.592042 | 1.0758e−16 | 1.00000 | B | 3.000000 | 0.030988 |
| ALASTA | CCCCCC | 1.0 | 0.0 | 1.0 | 6.347379 | 1.0833e−16 | 1.00000 | B | 1.000000 | 0.024219 |
| GTMKPV | CCCCCE | 1.7 | 0.0 | 1.0 | 6.517403 | 1.0847e−16 | 1.00000 | B | 1.700000 | 0.023001 |
| AEKGLV | HHHCCC | 1.0 | 0.0 | 1.0 | 6.758211 | 1.0864e−16 | 1.00000 | B | 1.000000 | 0.021425 |
| ANALAS | CCCCCC | 1.0 | 0.0 | 1.0 | 7.841519 | 1.0925e−16 | 1.00000 | B | 1.000000 | 0.016003 |
| YIKIHA | EECCCC | 1.5 | 0.0 | 1.0 | 7.920066 | 1.0928e−16 | 1.00000 | B | 1.500000 | 0.015692 |
| RITTLD | EEEEEE | 1.0 | 0.0 | 1.0 | 8.134587 | 1.0937e−16 | 1.00000 | B | 1.000000 | 0.014887 |
| NALAST | CCCCCC | 1.0 | 0.0 | 1.0 | 8.915828 | 1.0964e−16 | 1.00000 | B | 1.000000 | 0.012424 |
| RSLFLE | CCCHHH | 1.0 | 0.0 | 1.0 | 10.050382 | 1.0993e−16 | 1.00000 | B | 1.000000 | 0.009803 |
| GYRDNG | CCEEEE | 1.0 | 0.0 | 1.0 | 18.161797 | 1.1069e−16 | 1.00000 | B | 1.000000 | 0.003023 |
| GSGKTT | CCCHHH | 11.2 | 0.2 | 31.1 | 22.191557 | 4.5690e−16 | 1.00000 | B | 0.360129 | 0.007897 |
| SAGIGR | CCCCHH | 5.9 | 0.0 | 20.0 | 88.105700 | 8.7484e−16 | 1.00000 | B | 0.295000 | 0.000224 |
| DGGTGK | CCCCCC | 8.0 | 0.1 | 29.0 | 32.442436 | 1.3906e−15 | 1.00000 | B | 0.275862 | 0.002070 |
| LDNAGK | CCCCCH | 6.3 | 0.0 | 10.5 | 52.016926 | 1.6033e−15 | 1.00000 | B | 0.600000 | 0.001392 |
| GTGKTF | CCCHHH | 8.0 | 0.1 | 9.8 | 26.155884 | 2.0446e−15 | 1.00000 | B | 0.816327 | 0.009416 |
| NTKVDK | CEEEEE | 28.8 | 4.5 | 135.4 | 11.725183 | 2.2882e−15 | 1.00000 | B | 0.212703 | 0.032917 |
| SGVGKS | CCCHHH | 11.3 | 0.3 | 32.4 | 20.191824 | 3.7718e−15 | 1.00000 | B | 0.348765 | 0.009246 |
| GAGKTT | CCCHHH | 9.0 | 0.1 | 16.9 | 23.668066 | 4.2461e−15 | 1.00000 | B | 0.532544 | 0.008359 |
| GVGKSS | CCCHHH | 8.0 | 0.1 | 18.0 | 27.100944 | 1.1064e−14 | 1.00000 | B | 0.444444 | 0.004761 |
| ACNGDS | CCCCCC | 5.0 | 0.0 | 6.0 | 58.063960 | 1.7333e−14 | 1.00000 | B | 0.833333 | 0.001234 |
| IVNYTP | ECCCCC | 9.3 | 0.2 | 22.0 | 21.034466 | 8.1515e−14 | 1.00000 | B | 0.422727 | 0.008602 |
| MELCTL | EECCCC | 7.0 | 0.1 | 9.1 | 25.425349 | 1.0255e−13 | 1.00000 | B | 0.769231 | 0.008220 |
| CSAGIG | CCCCCH | 4.5 | 0.0 | 9.7 | 105.776723 | 1.0959e−13 | 1.00000 | B | 0.463918 | 0.000186 |
| LGNICR | CCCCCH | 4.0 | 0.0 | 7.8 | 98.011647 | 1.2752e−13 | 1.00000 | B | 0.512821 | 0.000213 |
| QTGTGK | CCCCCH | 7.5 | 0.1 | 10.0 | 25.450191 | 1.9828e−13 | 1.00000 | B | 0.750000 | 0.008561 |
| GVGKSN | CCCHHH | 6.3 | 0.0 | 11.0 | 31.334402 | 7.4332e−13 | 1.00000 | B | 0.572727 | 0.003642 |

TABLE 35-continued

| Sequence | Structure | In Epitopes | Expected in Epi | In PDB | Z-Score | P-Value Upper | P-Value Lower | Distribution | Observed Ratio | Null Probability |
|---|---|---|---|---|---|---|---|---|---|---|
| GQGIMS | CCCHHH | 5.0 | 0.0 | 5.0 | 36.328434 | 7.6590e−13 | 1.00000 | B | 1.000000 | 0.003774 |
| SSTGNT | CCCCHH | 7.0 | 0.1 | 6.0 | 22.498314 | 2.5846e−12 | 1.00000 | B | 1.166667 | 0.011715 |
| NVACKN | EECCCC | 13.3 | 0.9 | 43.0 | 12.867025 | 3.8275e−12 | 1.00000 | B | 0.309302 | 0.021930 |
| RIVNYT | EECCCC | 8.8 | 0.2 | 22.1 | 18.891805 | 3.9882e−12 | 1.00000 | B | 0.398190 | 0.009447 |
| DSGVGK | CCCCCC | 8.3 | 0.2 | 35.5 | 19.948620 | 4.0221e−12 | 1.00000 | B | 0.233803 | 0.004704 |
| QGSGKT | CCCCHH | 6.2 | 0.1 | 12.0 | 27.121341 | 4.5823e−12 | 1.00000 | B | 0.516667 | 0.004301 |
| PNGSGK | CCCCCH | 5.0 | 0.0 | 10.1 | 37.000198 | 5.0129e−12 | 1.00000 | B | 0.495050 | 0.001798 |
| GGTGKT | CCCCHH | 8.0 | 0.2 | 30.9 | 19.161996 | 5.2279e−12 | 1.00000 | B | 0.258900 | 0.005436 |
| KNVACK | EEECCC | 13.7 | 1.1 | 42.0 | 12.473295 | 6.8302e−12 | 1.00000 | B | 0.326190 | 0.025102 |
| GAGKTS | CCCHHH | 4.6 | 0.0 | 6.0 | 57.795480 | 7.3969e−12 | 1.00000 | B | 0.766667 | 0.001054 |
| NQTPNR | HHCHHH | 12.8 | 0.9 | 46.4 | 12.726660 | 1.4674e−11 | 1.00000 | B | 0.275862 | 0.019236 |
| VDHGKT | CCCCHH | 6.5 | 0.1 | 27.3 | 25.428433 | 2.6010e−11 | 1.00000 | B | 0.238095 | 0.002352 |
| QALSGL | HHHHHH | 3.0 | 0.0 | 5.0 | 109.114549 | 3.4511e−11 | 1.00000 | B | 0.600000 | 0.000151 |
| VSWGRG | EEECCC | 4.3 | 0.0 | 5.3 | 44.147984 | 5.1163e−11 | 1.00000 | B | 0.811321 | 0.001785 |
| SGSGKS | CCCHHH | 6.7 | 0.1 | 19.8 | 22.942534 | 5.9262e−11 | 1.00000 | B | 0.338384 | 0.004218 |
| NSGKTT | CCCHHH | 6.5 | 0.1 | 9.0 | 20.353985 | 7.7073e−11 | 1.00000 | B | 0.722222 | 0.011109 |
| GVGKTS | CCCHHH | 6.0 | 0.1 | 20.1 | 21.831417 | 9.5206e−11 | 1.00000 | B | 0.298507 | 0.003679 |
| DHGKTT | CCCHHH | 6.0 | 0.1 | 28.2 | 20.841979 | 2.0824e−10 | 1.00000 | B | 0.212766 | 0.002868 |
| LNVGMV | CEEEEE | 3.3 | 0.0 | 5.0 | 83.763342 | 2.0891e−10 | 1.00000 | B | 0.660000 | 0.000310 |
| QCGSCW | CCCHHH | 4.4 | 0.0 | 20.2 | 40.547665 | 3.4174e−10 | 1.00000 | B | 0.217822 | 0.000580 |
| PSGSGK | CCCCCH | 4.0 | 0.0 | 8.0 | 35.524057 | 4.3113e−10 | 1.00000 | B | 0.500000 | 0.001577 |
| GGVGKS | CCCHHH | 9.1 | 0.5 | 53.2 | 12.788361 | 8.0126e−10 | 1.00000 | B | 0.171053 | 0.008654 |
| GTGKTT | CCCHHH | 8.0 | 0.3 | 45.2 | 13.827063 | 9.0377e−10 | 1.00000 | B | 0.176991 | 0.006888 |
| GSTVEK | CEEEEE | 10.5 | 0.8 | 24.4 | 11.145641 | 9.7627e−10 | 1.00000 | B | 0.430328 | 0.032173 |
| LSGAGK | CCCCCH | 4.0 | 0.0 | 4.9 | 28.128509 | 1.2381e−09 | 1.00000 | B | 0.816327 | 0.004102 |
| EFTFPD | CCCCCC | 8.6 | 0.5 | 14.0 | 12.223542 | 1.3797e−09 | 1.00000 | B | 0.614286 | 0.032760 |
| VEFTFP | CCCCCC | 8.6 | 0.5 | 14.0 | 12.179844 | 1.4535e−09 | 1.00000 | B | 0.614286 | 0.032978 |
| GLGFSI | ECCEEE | 4.0 | 0.0 | 4.4 | 26.233665 | 1.5884e−09 | 1.00000 | B | 0.909091 | 0.005251 |
| NGSGKS | CCCCHH | 5.0 | 0.1 | 13.1 | 21.272338 | 1.6003e−09 | 1.00000 | B | 0.381679 | 0.004143 |
| SWGRGC | EEECCC | 4.3 | 0.0 | 5.3 | 28.630970 | 1.6081e−09 | 1.00000 | B | 0.811321 | 0.004230 |
| QGQGIM | CCCCHH | 4.8 | 0.0 | 5.0 | 26.582255 | 1.7583e−09 | 1.00000 | B | 0.960000 | 0.006475 |
| KCKACH | HCCCCC | 5.0 | 0.1 | 5.1 | 16.352193 | 2.3466e−09 | 1.00000 | B | 0.980392 | 0.017989 |
| AAGKST | CCCHHH | 4.1 | 0.0 | 6.0 | 26.934773 | 2.8975e−09 | 1.00000 | B | 0.683333 | 0.003833 |
| NVGKST | CCCHHH | 6.0 | 0.1 | 18.0 | 15.762169 | 3.6864e−09 | 1.00000 | B | 0.333333 | 0.007740 |
| PNVGKS | CCCCHH | 6.0 | 0.1 | 19.0 | 15.593755 | 4.3819e−09 | 1.00000 | B | 0.315789 | 0.007483 |
| WGHGYA | CCCHHH | 5.0 | 0.0 | 4.0 | 21.902956 | 4.6751e−09 | 1.00000 | B | 1.250000 | 0.008269 |
| GHGYAT | CCCHHH | 5.0 | 0.0 | 4.0 | 20.616189 | 7.5561e−09 | 1.00000 | B | 1.250000 | 0.009323 |
| RVEFTF | CCCCCC | 6.9 | 0.3 | 9.0 | 12.256272 | 1.1956e−08 | 1.00000 | B | 0.766667 | 0.033331 |
| ELGPLR | CCCCCE | 5.7 | 0.1 | 6.0 | 15.016070 | 1.2482e−08 | 1.00000 | B | 0.950000 | 0.023394 |
| GTGKSC | CCCHHH | 4.0 | 0.0 | 5.1 | 20.988541 | 1.3877e−08 | 1.00000 | B | 0.784314 | 0.007044 |
| STGAGK | CCCCCH | 4.6 | 0.0 | 7.1 | 23.047849 | 1.4152e−08 | 1.00000 | B | 0.647887 | 0.005546 |
| QRRGLG | CCCCHH | 5.0 | 0.1 | 6.0 | 14.511493 | 1.5619e−08 | 1.00000 | B | 0.833333 | 0.019253 |
| INGNSA | HHCCHH | 5.0 | 0.1 | 5.0 | 13.172405 | 1.7239e−08 | 1.00000 | B | 1.000000 | 0.028009 |
| STVEKT | EEEEEE | 9.5 | 0.8 | 24.4 | 10.028684 | 1.8503e−08 | 1.00000 | B | 0.389344 | 0.032003 |
| TLKGET | CCEEEE | 6.0 | 0.2 | 9.0 | 12.310119 | 1.9569e−08 | 1.00000 | B | 0.666667 | 0.025076 |
| PLRSFK | CCEEEE | 5.4 | 0.1 | 5.7 | 13.898421 | 2.5175e−08 | 1.00000 | B | 0.947368 | 0.025727 |
| GLTDWK | EECCCC | 5.2 | 0.1 | 9.4 | 15.570150 | 2.6117e−08 | 1.00000 | B | 0.553191 | 0.011510 |
| PGSGKG | CCCCEE | 5.0 | 0.1 | 10.1 | 15.466402 | 2.6172e−08 | 1.00000 | B | 0.495050 | 0.010033 |
| GPLRSF | CCCEEE | 5.5 | 0.2 | 5.8 | 13.909240 | 2.6726e−08 | 1.00000 | B | 0.948276 | 0.026176 |
| SPSSLS | ECCEEE | 15.8 | 2.7 | 85.6 | 8.005725 | 2.9307e−08 | 1.00000 | B | 0.184579 | 0.032087 |
| LGPLRS | CCCCEE | 5.7 | 0.2 | 6.0 | 13.596746 | 3.2676e−08 | 1.00000 | B | 0.950000 | 0.028372 |
| PSSLSA | CCEEEE | 13.1 | 1.8 | 90.4 | 8.382019 | 3.8044e−08 | 1.00000 | B | 0.144912 | 0.020372 |
| SVGKTS | CCCHHH | 4.0 | 0.0 | 10.0 | 20.358152 | 4.3082e−08 | 1.00000 | B | 0.400000 | 0.003802 |

TABLE 36

(Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| FxGHxA | CcCHhH | 10.6 | 0.1 | 13 | 40.14033 | 2.0626e−21 | 0.815385 | 0.005323 | 11 | 6 | 1 | 0.021 |
| FPGHxA | CCCHhH | 10.6 | 0.1 | 13 | 38.7496 | 4.1480e−21 | 0.815385 | 0.005708 | 11 | 6 | 1 | 0.021 |
| FPxHxA | CCcHhH | 11.6 | 0.1 | 14.2 | 36.45081 | 4.1020e−22 | 0.816901 | 0.007059 | 12 | 6 | 1 | 0.021 |
| ExxxMD | HhhhEC | 16.7 | 0.2 | 36.2 | 35.39318 | 6.7544e−27 | 0.461326 | 0.006027 | 17 | 8 | 1 | 5.181 |
| FPGH | CCCH | 11.5 | 0.2 | 16.2 | 28.66959 | 1.9821e−19 | 0.709877 | 0.009756 | 11 | 6 | 1 | 0.021 |
| FxxHxA | CccHhH | 11.6 | 0.2 | 19 | 27.92433 | 7.9156e−19 | 0.610526 | 0.008899 | 12 | 6 | 1 | 0.021 |
| ERxxMD | HHhhEC | 15.1 | 0.2 | 36.2 | 30.59899 | 8.7736e−24 | 0.417127 | 0.00656 | 17 | 8 | 1 | 5.134 |
| LGxSI | CCeEE | 12.5 | 0.2 | 38.3 | 25.47832 | 3.4342e−18 | 0.326371 | 0.006089 | 12 | 13 | 8 | 5 |
| FxGH | CcCH | 12.2 | 0.2 | 23.1 | 25.02609 | 1.0525e−18 | 0.528139 | 0.010002 | 12 | 7 | 2 | 0.021 |
| PxHxAL | CcHhHC | 11 | 0.3 | 13.1 | 20.59324 | 3.3394e−17 | 0.839695 | 0.021144 | 11 | 5 | 1 | 0 |
| PGHxxL | CCHhhC | 11.7 | 0.3 | 13 | 21.21613 | 1.9065e−17 | 0.9 | 0.022743 | 11 | 5 | 1 | 0 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| RxxMDS | HhhECC | 16.7 | 0.4 | 42.2 | 24.91901 | 6.1180e-22 | 0.395735 | 0.010205 | 18 | 10 | 1 | 5.157 |
| RxxMD | HhhEC | 17.1 | 0.6 | 44.2 | 22.2385 | 2.7644e-21 | 0.386878 | 0.012675 | 19 | 10 | 1 | 5.157 |
| KxxFTV | HhcCCH | 11.1 | 0.4 | 14.1 | 17.68718 | 1.7765e-15 | 0.787234 | 0.026782 | 12 | 7 | 7 | 0 |
| KxxFxV | HhcCcH | 11.6 | 0.4 | 15.8 | 17.89308 | 3.6601e-15 | 0.734177 | 0.025436 | 13 | 8 | 8 | 0 |
| FPGxxA | CCChhH | 11.6 | 0.4 | 23 | 17.67412 | 2.5125e-14 | 0.504348 | 0.017749 | 11 | 6 | 1 | 0.021 |
| NYTxxL | CCCccC | 10.1 | 0.4 | 33 | 16.31284 | 1.6032e-12 | 0.306061 | 0.010921 | 11 | 2 | 1 | 1.5 |
| VACxxG | ECCccC | 33.4 | 1.2 | 47.1 | 29.57423 | 6.3139e-42 | 0.70913 | 0.025811 | 29 | 15 | 1 | 5.755 |
| PxHxxL | CcHhhC | 12.9 | 0.5 | 18.3 | 18.1817 | 2.5192e-16 | 0.704918 | 0.026188 | 12 | 5 | 1 | 0 |
| FPxH | CCcH | 12.5 | 0.5 | 22.2 | 17.81482 | 2.2978e-15 | 0.563063 | 0.020995 | 12 | 6 | 1 | 0.021 |
| LxxNVM | CchHHH | 18.1 | 0.7 | 30.9 | 20.92111 | 3.8340e-22 | 0.585761 | 0.022891 | 18 | 12 | 1 | 1.542 |
| VACKxG | ECCCcC | 31.1 | 1.2 | 45 | 27.21317 | 4.3643e-38 | 0.691111 | 0.027516 | 27 | 13 | 1 | 5.505 |
| NYTPxL | CCCCcC | 10.1 | 0.4 | 32 | 15.30607 | 4.9076e-12 | 0.315625 | 0.012696 | 11 | 2 | 1 | 1.5 |
| CKxGxT | CCcCcC | 27.2 | 1.1 | 50 | 25.15354 | 9.5225e-32 | 0.544 | 0.022017 | 26 | 14 | 1 | 5.231 |
| VxCxxG | EcCcC | 40.5 | 1.7 | 79.3 | 30.25631 | 1.7042e-45 | 0.510719 | 0.021207 | 37 | 19 | 1 | 8.755 |
| PGHxA | CCHhH | 11.3 | 0.5 | 18.8 | 15.37671 | 2.0088e-13 | 0.601064 | 0.026934 | 12 | 7 | 2 | 0.688 |
| VACxNG | ECCcCC | 21.6 | 1 | 44 | 21.15107 | 8.7514e-24 | 0.490909 | 0.022104 | 19 | 13 | 1 | 4.438 |
| VxCKxG | EcCCcC | 37.2 | 1.7 | 58.6 | 27.64679 | 3.2831e-42 | 0.634812 | 0.028979 | 34 | 16 | 1 | 8.505 |
| MDSS | ECCC | 14.9 | 0.7 | 43.2 | 17.35742 | 4.1795e-16 | 0.344907 | 0.015781 | 15 | 10 | 2 | 5.204 |
| VxCxNG | EcCxCC | 27.6 | 1.3 | 56.3 | 22.96562 | 2.7459e-29 | 0.490231 | 0.02379 | 25 | 15 | 1 | 7.438 |
| VACKNG | ECCCCC | 20.6 | 1 | 43 | 19.82843 | 5.1410e-22 | 0.47907 | 0.023263 | 18 | 12 | 1 | 4.438 |
| NxTPxL | CcCCcC | 11.8 | 0.6 | 39.8 | 14.91701 | 1.9147e-12 | 0.296482 | 0.014437 | 13 | 4 | 3 | 3.334 |
| GFTxS | CChHH | 25.7 | 1.3 | 42.2 | 21.82477 | 7.8086e-28 | 0.609005 | 0.030577 | 24 | 15 | 1 | 4.165 |
| IVNYxP | ECCCcC | 10.3 | 0.5 | 22 | 13.76618 | 1.8207e-11 | 0.468182 | 0.023508 | 12 | 2 | 1 | 1.375 |
| GFxNS | CChHH | 25.7 | 1.3 | 43.2 | 21.48449 | 2.0443e-27 | 0.594907 | 0.030734 | 24 | 15 | 1 | 4.171 |
| GFTNS | CCHHH | 24.7 | 1.3 | 41.2 | 20.89447 | 2.9243e-26 | 0.599515 | 0.031442 | 23 | 14 | 1 | 4.165 |
| VxCKNG | EcCCCC | 26.6 | 1.4 | 55.2 | 21.38084 | 4.0094e-27 | 0.481884 | 0.025784 | 24 | 14 | 1 | 7.438 |
| IVxYxP | ECcCcC | 10.3 | 0.6 | 23 | 13.2175 | 4.2034e-11 | 0.447826 | 0.024211 | 12 | 2 | 1 | 1.375 |
| IVNxxP | ECCccC | 10.3 | 0.6 | 22 | 13.08393 | 4.5307e-11 | 0.468182 | 0.025815 | 12 | 2 | 1 | 1.375 |
| LxxNxM | CchHhH | 18.1 | 1 | 44.6 | 17.17364 | 1.8356e-18 | 0.40583 | 0.022712 | 18 | 12 | 1 | 1.542 |
| GHxxL | CHhhC | 13.2 | 0.8 | 17.8 | 14.59737 | 6.8060e-15 | 0.741573 | 0.042626 | 12 | 7 | 2 | 0 |
| LxxxVM | CchhHH | 23.7 | 1.4 | 59.7 | 19.2235 | 6.7876e-23 | 0.396985 | 0.023116 | 22 | 14 | 2 | 1.542 |
| ACKxG | CCCcC | 34.1 | 2 | 46.4 | 23.18366 | 1.3729e-36 | 0.734914 | 0.043173 | 29 | 16 | 1 | 6.755 |
| GxTNS | CcHHH | 24.7 | 1.5 | 42.7 | 19.6171 | 6.3209e-25 | 0.578454 | 0.034045 | 23 | 14 | 1 | 4.165 |
| RIxxNL | HHhhHH | 16.5 | 1 | 44 | 15.84119 | 4.4922e-16 | 0.375 | 0.022308 | 17 | 5 | 2 | 5.708 |
| NxGYH | EcCcC | 11.7 | 0.7 | 37.8 | 13.20822 | 2.2537e-11 | 0.309524 | 0.018678 | 13 | 7 | 1 | 4.817 |
| VACxN | ECCcC | 21.9 | 1.3 | 45 | 18.01829 | 2.2608e-21 | 0.486667 | 0.029818 | 20 | 14 | 1 | 5.188 |
| PSVY | CEEE | 17.5 | 1.1 | 268.7 | 15.82354 | 1.2792e-15 | 0.065128 | 0.004023 | 23 | 13 | 1 | 3.071 |
| CxNGxT | CcCCcC | 19 | 1.2 | 51.6 | 16.57241 | 2.1832e-18 | 0.368217 | 0.022926 | 19 | 15 | 1 | 4.652 |
| CKNGxT | CcCCcC | 16.8 | 1.1 | 47.2 | 15.53404 | 7.2121e-16 | 0.355932 | 0.022272 | 16 | 12 | 1 | 3.438 |
| FTxxxN | CChhhH | 10 | 0.6 | 19.8 | 12.03098 | 1.2267e-10 | 0.505051 | 0.031658 | 10 | 6 | 6 | 1 |
| NxQxQF | CcCcCE | 10.1 | 0.6 | 29.2 | 11.9082 | 3.6689e-10 | 0.34589 | 0.022079 | 11 | 11 | 1 | 1 |
| QFxTN | CEcCC | 17.3 | 1.1 | 28.1 | 15.7038 | 1.4457e-17 | 0.615658 | 0.039391 | 13 | 15 | 1 | 6 |
| NxxYH | EccCC | 11.7 | 0.8 | 37.8 | 12.74759 | 4.4345e-11 | 0.309524 | 0.019907 | 13 | 7 | 1 | 4.817 |
| ERxxxD | HHhheC | 16.2 | 1 | 36.2 | 15.05407 | 8.6591e-16 | 0.447514 | 0.028832 | 18 | 9 | 1 | 6.134 |
| LxxKDY | HhhCCC | 12.4 | 0.8 | 17.5 | 13.25842 | 4.4705e-13 | 0.708571 | 0.045827 | 11 | 5 | 2 | 0.333 |
| QFNTN | CECCC | 16.8 | 1.1 | 28.1 | 15.36943 | 1.1857e-16 | 0.597865 | 0.038692 | 12 | 14 | 1 | 6 |
| NVACK | EECCC | 24.2 | 1.6 | 45 | 18.28235 | 1.9905e-23 | 0.537778 | 0.035242 | 23 | 10 | 1 | 5.523 |
| PGxxAL | CChhHC | 10.3 | 0.7 | 15.5 | 11.89251 | 7.8512e-11 | 0.664516 | 0.044128 | 10 | 5 | 1 | 0 |
| VxCKN | EcCCC | 27.9 | 1.9 | 55.4 | 19.44521 | 3.8832e-26 | 0.50361 | 0.033503 | 26 | 16 | 1 | 8.188 |
| NVACxN | EECCcC | 14.3 | 1 | 43.1 | 13.79284 | 2.2413e-13 | 0.331787 | 0.022206 | 14 | 10 | 1 | 4.392 |
| CKNxxT | CCCccC | 16.8 | 1.2 | 47.7 | 14.76365 | 3.0318e-15 | 0.352201 | 0.024136 | 16 | 12 | 1 | 3.438 |
| NxTPNR | HhCHHH | 13.8 | 1 | 46.4 | 13.28837 | 1.7188e-12 | 0.297414 | 0.020563 | 14 | 10 | 1 | 3.816 |
| VAxKxG | ECcCcC | 31.1 | 2.2 | 50.4 | 20.1751 | 6.0519e-30 | 0.617063 | 0.042673 | 27 | 13 | 1 | 5.505 |
| VACKN | ECCCC | 20.9 | 1.5 | 43 | 16.41255 | 2.2938e-19 | 0.486047 | 0.033792 | 19 | 13 | 1 | 5.188 |
| GYSxxN | CEChhH | 13 | 0.9 | 42.3 | 12.84295 | 3.1635e-12 | 0.307329 | 0.021422 | 15 | 15 | 1 | 3.062 |
| GFxxxG | CEeeeE | 11.7 | 0.8 | 72.6 | 12.12061 | 2.1618e-10 | 0.161157 | 0.011234 | 12 | 13 | 6 | 3.5 |
| NQTPNR | HHCHHH | 12.8 | 0.9 | 46.4 | 12.72666 | 1.4674e-11 | 0.275862 | 0.019236 | 13 | 9 | 1 | 3.816 |
| YSxMS | CCcEE | 11.7 | 0.8 | 42.8 | 12.16388 | 1.2625e-10 | 0.273364 | 0.019069 | 15 | 14 | 1 | 3.966 |
| KxYRxE | CcCCcC | 11.8 | 0.8 | 21.3 | 12.33046 | 1.9943e-11 | 0.553991 | 0.038696 | 10 | 4 | 2 | 0.333 |
| NxACK | EcCCC | 24.2 | 1.7 | 45 | 17.62335 | 9.2961e-23 | 0.537778 | 0.037658 | 23 | 10 | 1 | 5.523 |
| NQTxNR | HHChHH | 12.8 | 0.9 | 46.4 | 12.69165 | 1.5524e-11 | 0.275862 | 0.01933 | 13 | 9 | 1 | 3.816 |
| NVxCK | EEcCC | 24.2 | 1.7 | 45 | 17.59016 | 1.0058e-22 | 0.537778 | 0.037786 | 23 | 10 | 1 | 5.523 |
| YTPxL | CCCcC | 11.1 | 0.8 | 39.8 | 11.76239 | 2.0298e-10 | 0.278894 | 0.019713 | 12 | 3 | 1 | 1.5 |
| NVAC | EECC | 26.5 | 1.9 | 49.4 | 18.34496 | 1.9069e-24 | 0.536437 | 0.037918 | 25 | 12 | 1 | 5.773 |
| NVACKN | EECCCC | 13.3 | 0.9 | 43 | 12.86703 | 3.8275e-12 | 0.309302 | 0.02193 | 13 | 9 | 1 | 4.392 |
| QFNxN | CECcC | 17.1 | 1.2 | 28.1 | 14.7482 | 8.3663e-17 | 0.608541 | 0.043159 | 12 | 14 | 1 | 6 |
| FTVA | CCHH | 13.1 | 0.9 | 19.6 | 12.93532 | 2.1141e-13 | 0.668367 | 0.047415 | 14 | 8 | 7 | 0 |
| VxCxN | EcCcC | 28.9 | 2.1 | 67.3 | 19.01138 | 1.1251e-25 | 0.429421 | 0.030557 | 27 | 17 | 1 | 8.188 |
| YSTMS | CCCEE | 11.7 | 0.8 | 42.8 | 12.01448 | 1.5892e-10 | 0.273364 | 0.01949 | 15 | 14 | 1 | 3.966 |
| PPGPP | CCCCC | 16.8 | 1.2 | 31 | 14.51712 | 1.0146e-15 | 0.541935 | 0.038746 | 2 | 17 | 2 | 0 |
| NxTxNR | HhChHH | 13.8 | 1 | 47.4 | 13.0352 | 2.7237e-12 | 0.291139 | 0.020818 | 14 | 10 | 1 | 3.816 |
| ERxxM | HHhhE | 17.3 | 1.2 | 36.5 | 14.66555 | 4.8047e-16 | 0.473973 | 0.034006 | 18 | 9 | 1 | 5.134 |
| GxGF | EcCE | 16.8 | 1.2 | 40.5 | 14.39904 | 3.7361e-15 | 0.414815 | 0.029841 | 16 | 18 | 9 | 7.666 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| NVxCxN | EEcCcC | 14.3 | 1 | 43.1 | 13.21465 | 6.2025e−13 | 0.331787 | 0.023961 | 14 | 10 | 1 | 4.392 |
| YxTMS | CcCEE | 11.7 | 0.8 | 42.8 | 11.91659 | 1.8497e−10 | 0.273364 | 0.019773 | 15 | 14 | 1 | 3.966 |
| GFxxS | CChhH | 27 | 2 | 67.8 | 18.15516 | 5.3814e−24 | 0.39823 | 0.028894 | 26 | 18 | 2 | 4.171 |
| VACK | ECCC | 33.2 | 2.4 | 45 | 20.37365 | 1.4230e−32 | 0.737778 | 0.053619 | 30 | 14 | 1 | 6.435 |
| VxCK | EcCC | 42 | 3.1 | 60.9 | 22.84323 | 2.8454e−40 | 0.689655 | 0.050241 | 40 | 20 | 1 | 9.435 |
| NxAC | EeCC | 27 | 2 | 50.4 | 18.15349 | 6.3631e−25 | 0.535714 | 0.039237 | 25 | 12 | 1 | 5.773 |
| NxTPxR | HhCHhH | 13.9 | 1 | 46.4 | 12.9093 | 2.3592e−12 | 0.299569 | 0.021942 | 14 | 10 | 1 | 3.829 |
| SxMS | CcEE | 14.9 | 1.1 | 51.5 | 13.35327 | 3.9684e−13 | 0.28932 | 0.021211 | 17 | 17 | 1 | 4.466 |
| STMS | CCEE | 14.9 | 1.1 | 42.8 | 13.37733 | 2.6626e−13 | 0.348131 | 0.025541 | 17 | 17 | 1 | 4.466 |
| NVxC | EEcC | 26.5 | 1.9 | 52.2 | 17.92263 | 8.5115e−24 | 0.507663 | 0.037341 | 25 | 12 | 1 | 5.773 |
| NxACxN | EeCCcC | 14.3 | 1.1 | 43 | 12.98435 | 9.3387e−13 | 0.332558 | 0.024775 | 14 | 10 | 1 | 4.392 |
| QFxT | CEcC | 21.3 | 1.6 | 29.7 | 16.06162 | 9.1250e−21 | 0.717172 | 0.053568 | 17 | 19 | 2 | 7 |
| TVAxxE | CHHhhH | 14.8 | 1.1 | 24.2 | 13.27204 | 6.4829e−14 | 0.61157 | 0.046058 | 15 | 9 | 8 | 1 |
| NQTPxR | HHChhH | 12.9 | 1 | 46.4 | 12.19015 | 2.5665e−11 | 0.278017 | 0.02106 | 13 | 9 | 1 | 3.829 |
| TMxRI | HHhHH | 11.4 | 0.9 | 25.5 | 11.525 | 1.5721e−10 | 0.447059 | 0.033919 | 14 | 4 | 1 | 3.146 |
| YxxMS | CccEE | 11.7 | 0.9 | 44.7 | 11.58861 | 3.2547e−10 | 0.261745 | 0.019868 | 15 | 14 | 1 | 3.966 |
| ACxNG | CCcCC | 22.7 | 1.7 | 46.9 | 16.27224 | 5.2201e−20 | 0.484009 | 0.03678 | 20 | 15 | 2 | 4.549 |
| ACKNG | CCCCC | 21.6 | 1.7 | 43 | 15.80433 | 3.8946e−19 | 0.502326 | 0.038517 | 18 | 13 | 1 | 4.438 |
| KxVxCK | EeEcCC | 17.6 | 1.4 | 47.7 | 14.18337 | 3.3780e−15 | 0.368973 | 0.028318 | 19 | 10 | 1 | 2.55 |
| KxVAC | EeECC | 17.6 | 1.4 | 42 | 14.19049 | 2.2162e−15 | 0.419048 | 0.032245 | 19 | 12 | 1 | 2.8 |
| KNVACK | EEECCC | 13.7 | 1.1 | 42 | 12.4733 | 6.8302e−12 | 0.32619 | 0.025102 | 15 | 9 | 1 | 2.431 |
| RxxMxS | HhhEcC | 16.7 | 1.3 | 42.2 | 13.80189 | 1.5849e−14 | 0.395735 | 0.030483 | 18 | 10 | 1 | 5.157 |
| KxVACK | EeECCC | 15.3 | 1.2 | 42 | 13.18095 | 1.8560e−13 | 0.364286 | 0.028111 | 16 | 9 | 1 | 2.55 |
| NQTxxR | HHChhH | 12.9 | 1 | 46.4 | 12.05315 | 3.2314e−11 | 0.278017 | 0.021481 | 13 | 9 | 1 | 3.829 |
| KNxAC | EEeCC | 16.4 | 1.3 | 42 | 13.64298 | 2.3347e−14 | 0.390476 | 0.030201 | 18 | 12 | 1 | 2.681 |
| NxTxxR | HhChhH | 13.9 | 1.1 | 47.4 | 12.49716 | 5.0108e−12 | 0.293249 | 0.022727 | 14 | 10 | 1 | 3.829 |
| FxTxxR | ChHhhH | 13.6 | 1.1 | 20.2 | 12.53096 | 6.0951e−13 | 0.673267 | 0.052338 | 13 | 7 | 1 | 2.833 |
| GYxxxN | CEchhH | 14 | 1.1 | 42.3 | 12.53642 | 1.6774e−12 | 0.330969 | 0.025738 | 16 | 16 | 1 | 3.062 |
| NVxCKN | EEcCCC | 13.3 | 1 | 43 | 12.19847 | 1.2220e−11 | 0.309302 | 0.024087 | 13 | 9 | 1 | 4.392 |
| KNVAC | EEECC | 15.9 | 1.2 | 42.1 | 13.36749 | 7.6225e−14 | 0.377672 | 0.029438 | 18 | 12 | 1 | 2.681 |
| NxxCxN | EecCcC | 14.5 | 1.1 | 43 | 12.72668 | 1.5589e−11 | 0.337209 | 0.026349 | 14 | 11 | 1 | 4.438 |
| KNxxC | EEecC | 16.4 | 1.3 | 42 | 13.54722 | 2.8206e−14 | 0.390476 | 0.030577 | 18 | 12 | 1 | 2.681 |
| KNVxC | EEEEcC | 15.9 | 1.2 | 42.1 | 13.32532 | 8.2636e−14 | 0.377672 | 0.029601 | 18 | 12 | 1 | 2.681 |
| WCxP | CChH | 33.3 | 2.6 | 62.5 | 19.37311 | 4.2055e−29 | 0.5328 | 0.041887 | 35 | 40 | 17 | 8.539 |
| QFNT | CECC | 19.8 | 1.6 | 28.2 | 15.03871 | 1.4634e−18 | 0.702128 | 0.05523 | 15 | 17 | 1 | 7 |
| KNVxCK | EEEcCC | 13.7 | 1.1 | 42 | 12.27342 | 9.7008e−12 | 0.32619 | 0.025822 | 15 | 9 | 1 | 2.431 |
| VAxKNG | ECcCCC | 20.6 | 1.6 | 43 | 15.11451 | 7.1138e−18 | 0.47907 | 0.038057 | 18 | 12 | 1 | 4.438 |
| FRxxD | HHhhC | 17.5 | 1.4 | 102.5 | 13.73082 | 3.4864e−14 | 0.170732 | 0.013607 | 20 | 21 | 8 | 1.25 |
| RxxLPE | HhhCCC | 11.6 | 0.9 | 30.6 | 11.27164 | 3.4023e−10 | 0.379085 | 0.030226 | 12 | 7 | 6 | 2.06 |
| FTxS | CHhH | 27.7 | 2.2 | 52.5 | 17.49009 | 6.0171e−24 | 0.527619 | 0.042219 | 26 | 17 | 2 | 4.171 |
| FTNS | CHHH | 25.7 | 2.1 | 47.2 | 16.82928 | 2.2403e−22 | 0.544492 | 0.043704 | 24 | 15 | 1 | 4.171 |
| FxGxxA | CcChhH | 13.1 | 1.1 | 51 | 11.86862 | 2.5395e−11 | 0.256863 | 0.02063 | 13 | 8 | 3 | 0.021 |
| NxACKN | EeCCCC | 13.3 | 1.1 | 43 | 11.98020 | 1.8020e−11 | 0.309302 | 0.024858 | 13 | 9 | 1 | 4.392 |
| QTxxAK | HHhhHH | 11.5 | 0.9 | 25.1 | 11.04198 | 3.3849e−10 | 0.458167 | 0.037806 | 8 | 10 | 4 | 2 |
| SxKPxY | CcCCcC | 12.3 | 1 | 23.8 | 11.4035 | 4.1050e−11 | 0.516807 | 0.042941 | 12 | 11 | 3 | 0.511 |
| TxxLxK | CccCcH | 12.8 | 1.1 | 41.4 | 11.51471 | 9.3815e−11 | 0.309179 | 0.025747 | 15 | 7 | 6 | 2 |
| VAC | ECC | 35.5 | 3 | 69.4 | 19.30368 | 1.0904e−29 | 0.511527 | 0.042754 | 32 | 16 | 1 | 6.685 |
| ExxxxD | HhhheC | 18.8 | 1.6 | 44.9 | 13.98063 | 1.0075e−15 | 0.418708 | 0.035042 | 19 | 10 | 2 | 6.181 |
| KNxACK | EEeCCC | 13.7 | 1.1 | 42 | 11.87452 | 1.9766e−11 | 0.32619 | 0.027349 | 15 | 9 | 1 | 2.431 |
| NxxCK | EecCC | 24.2 | 2 | 45 | 15.92761 | 6.0120e−21 | 0.537778 | 0.045091 | 23 | 10 | 1 | 5.523 |
| NxxxQF | CcccCE | 17.8 | 1.5 | 51.1 | 13.54533 | 1.1983e−14 | 0.348337 | 0.029216 | 15 | 16 | 2 | 5 |
| FxNS | ChHH | 27.7 | 2.3 | 55.4 | 16.95863 | 3.7819e−23 | 0.5 | 0.042157 | 26 | 17 | 2 | 4.176 |
| QTPNR | HCHHH | 17.2 | 1.5 | 46.4 | 13.22939 | 2.0671e−14 | 0.37069 | 0.031495 | 18 | 13 | 1 | 5.816 |
| GSTVE | CEEEE | 15.9 | 1.4 | 24.4 | 12.86514 | 2.1829e−14 | 0.651639 | 0.055473 | 17 | 10 | 1 | 1.048 |
| ExxxM | HhhhE | 21 | 1.8 | 40.6 | 14.696 | 2.8903e−18 | 0.517241 | 0.044034 | 20 | 11 | 2 | 5.181 |
| CExxxY | EEcccC | 17.7 | 1.5 | 50.9 | 13.36287 | 2.0202e−14 | 0.347421 | 0.029713 | 18 | 13 | 1 | 8.785 |
| STVExT | EEEEeE | 11.4 | 1 | 24.4 | 10.71527 | 5.4506e−10 | 0.467213 | 0.04035 | 12 | 4 | 1 | 1 |
| NQxPNR | HHcHHH | 12.9 | 1.1 | 47.4 | 11.21815 | 1.4078e−10 | 0.272152 | 0.023798 | 13 | 9 | 1 | 3.818 |
| MxxSRN | HhhHCC | 13.4 | 1.2 | 42 | 11.44511 | 4.7252e−11 | 0.319048 | 0.027951 | 16 | 6 | 1 | 1.311 |
| QTPxR | HCHhH | 17.2 | 1.5 | 46.4 | 12.98164 | 3.4999e−14 | 0.37069 | 0.032542 | 18 | 13 | 1 | 5.829 |
| QTxNR | HChHH | 17.2 | 1.5 | 46.4 | 12.93232 | 3.8897e−14 | 0.37069 | 0.032756 | 18 | 13 | 1 | 5.816 |
| KNxxCK | EEecCC | 13.7 | 1.2 | 42 | 11.50467 | 3.8780e−11 | 0.32619 | 0.028883 | 15 | 9 | 1 | 2.431 |
| QFxxN | CEccC | 17.6 | 1.6 | 32.4 | 13.17019 | 6.2448e−15 | 0.54321 | 0.048103 | 13 | 15 | 1 | 6 |
| NxxCKN | EecCCC | 13.3 | 1.2 | 43 | 11.28729 | 6.3736e−11 | 0.309302 | 0.027552 | 13 | 9 | 1 | 4.392 |
| GxTxS | CcHhH | 25.7 | 2.3 | 77.1 | 15.70055 | 6.1084e−20 | 0.333333 | 0.029715 | 24 | 15 | 1 | 4.165 |
| WCGP | CCHH | 23.2 | 2.1 | 48.1 | 14.99016 | 3.7261e−19 | 0.482328 | 0.043149 | 23 | 26 | 10 | 4.472 |
| GxGxxI | EcCeeE | 12.5 | 1.1 | 47.7 | 10.87978 | 4.3984e−10 | 0.262055 | 0.023487 | 15 | 20 | 10 | 3.741 |
| NxxPNR | HhcHHH | 13.9 | 1.2 | 47.4 | 11.48023 | 3.1658e−10 | 0.293249 | 0.026318 | 14 | 10 | 1 | 3.821 |
| LxxSI | CceEE | 12.8 | 1.2 | 68.5 | 10.91686 | 4.6230e−10 | 0.186861 | 0.01689 | 13 | 14 | 9 | 5.25 |
| DxPExL | EhHHhH | 12.7 | 1.2 | 38 | 10.91795 | 2.7228e−10 | 0.334211 | 0.030355 | 14 | 6 | 1 | 1 |
| GxSxxN | CeChhH | 21.5 | 2 | 57.9 | 14.18641 | 6.8792e−17 | 0.37133 | 0.033905 | 24 | 20 | 1 | 3.231 |
| CxxGxT | CccCcC | 36.2 | 3.3 | 126.6 | 18.27505 | 5.0452e−27 | 0.28594 | 0.026253 | 34 | 24 | 6 | 8.695 |
| TLIS | EEEE | 13.7 | 1.3 | 44.6 | 11.22934 | 7.1321e−11 | 0.307175 | 0.028307 | 15 | 1 | 1 | 1.601 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| FPExLT | HHHhHH | 14.2 | 1.3 | 57.9 | 11.37831 | 2.9795e−11 | 0.24525 | 0.02267 | 16 | 4 | 1 | 2 |
| DxQAxC | HhHHhH | 12 | 1.1 | 49.1 | 10.41466 | 8.3369e−10 | 0.244399 | 0.022756 | 14 | 4 | 1 | 2.023 |
| KxxACK | EeeCCC | 15.3 | 1.4 | 42 | 11.76957 | 3.0198e−12 | 0.364286 | 0.034205 | 16 | 9 | 1 | 2.55 |
| LSxxYH | HHHhHH | 26.5 | 2.5 | 52.5 | 15.58336 | 4.0718e−21 | 0.504762 | 0.047463 | 26 | 29 | 7 | 6.747 |
| CKNG | CCCC | 32.8 | 3.1 | 60.3 | 17.22489 | 5.4973e−26 | 0.543947 | 0.0519 | 30 | 21 | 2 | 7.606 |
| KxVxC | EeEcC | 19.9 | 1.9 | 57.7 | 13.26771 | 2.7457e−15 | 0.344887 | 0.032977 | 22 | 13 | 1 | 2.8 |
| PxHxA | CcHhH | 13.8 | 1.3 | 42.8 | 11.02507 | 8.4644e−11 | 0.32243 | 0.030883 | 16 | 9 | 4 | 0.688 |
| QTxxR | HChhH | 18.2 | 1.8 | 48.4 | 12.64218 | 2.9192e−14 | 0.376033 | 0.036274 | 19 | 14 | 2 | 5.829 |
| KxxxCK | EeecCC | 17.6 | 1.7 | 48.7 | 12.38274 | 1.5752e−13 | 0.361396 | 0.035054 | 19 | 10 | 1 | 2.55 |
| SRW | CHH | 21.5 | 2.1 | 52.8 | 13.57701 | 2.1455e−16 | 0.407197 | 0.040196 | 23 | 13 | 1 | 2.333 |
| PxxxAL | CchhHC | 12.4 | 1.2 | 28.2 | 10.32078 | 4.9428e−10 | 0.439716 | 0.043459 | 12 | 6 | 2 | 0 |
| NQxPxR | HHcHhH | 12.9 | 1.3 | 49.2 | 10.41678 | 6.2879e−10 | 0.262195 | 0.025975 | 13 | 9 | 1 | 3.831 |
| KxxAC | EeeCC | 18.1 | 1.8 | 44 | 12.34444 | 3.9683e−14 | 0.411364 | 0.041254 | 19 | 12 | 1 | 2.8 |
| KSRW | CCHH | 15.6 | 1.6 | 45.6 | 11.35132 | 8.7811e−12 | 0.342105 | 0.034653 | 18 | 10 | 1 | 2.333 |
| DKPxY | CCCcC | 13.2 | 1.3 | 21.2 | 10.59411 | 3.0412e−11 | 0.622642 | 0.063119 | 12 | 15 | 2 | 0.154 |
| QxPNR | HcHHH | 17.2 | 1.8 | 47.4 | 11.86389 | 4.3286e−13 | 0.362869 | 0.037114 | 18 | 13 | 1 | 5.818 |
| RIxxxQ | CCchhH | 14.1 | 1.5 | 60.7 | 10.62227 | 1.3315e−10 | 0.23229 | 0.023928 | 14 | 14 | 10 | 4.532 |
| TMS | CEE | 18 | 1.9 | 61.6 | 11.97645 | 2.1832e−13 | 0.292208 | 0.030366 | 20 | 20 | 2 | 4.966 |
| FNTN | ECCC | 18.2 | 1.9 | 37.6 | 12.12908 | 3.7927e−14 | 0.484043 | 0.05058 | 13 | 15 | 2 | 6 |
| ACKN | CCCC | 22.1 | 2.3 | 44 | 13.35197 | 4.5720e−17 | 0.502273 | 0.052665 | 19 | 14 | 1 | 5.938 |
| SxYQxE | ChHHhH | 14.9 | 1.6 | 34.9 | 10.89402 | 1.9565e−11 | 0.426934 | 0.044931 | 12 | 17 | 2 | 0.035 |
| QxNTN | CeCCC | 17.4 | 1.8 | 28.1 | 11.88416 | 5.1239e−14 | 0.619217 | 0.065309 | 12 | 14 | 1 | 6 |
| CxNxxT | CcCccC | 21.3 | 2.3 | 79.4 | 12.86602 | 4.0656e−15 | 0.268262 | 0.028403 | 20 | 16 | 2 | 5.815 |
| RxxxDS | HhheCC | 16.7 | 1.8 | 45.2 | 11.42834 | 2.6297e−12 | 0.369469 | 0.039275 | 18 | 10 | 1 | 5.157 |
| YSTM | CCCE | 19.6 | 2.1 | 42.7 | 12.43726 | 1.1609e−14 | 0.459016 | 0.04883 | 21 | 21 | 1 | 4.292 |
| MxxSxN | HhhHcC | 14.4 | 1.5 | 54.6 | 10.54436 | 1.5677e−10 | 0.263736 | 0.028063 | 17 | 7 | 2 | 3.311 |
| KPLY | CCCC | 17.3 | 1.9 | 20.1 | 11.92052 | 1.7658e−15 | 0.860697 | 0.092045 | 13 | 18 | 1 | 0.511 |
| VxxKNG | EccCCC | 26.6 | 2.8 | 57.3 | 14.43446 | 1.7747e−19 | 0.464223 | 0.049723 | 24 | 14 | 1 | 7.438 |
| LxxKxY | HhhCcC | 22.3 | 2.4 | 89.2 | 13.02413 | 1.5264e−15 | 0.25 | 0.026898 | 18 | 12 | 7 | 0.583 |
| YxTM | CcCE | 19.6 | 2.1 | 43.7 | 12.25205 | 2.0037e−14 | 0.448513 | 0.048882 | 21 | 21 | 1 | 4.292 |
| GSTxE | CEEeE | 15.9 | 1.8 | 28 | 10.9919 | 2.4901e−12 | 0.567857 | 0.063033 | 17 | 10 | 1 | 1.048 |
| LxSxxR | CcHhhH | 20 | 2.2 | 79.5 | 12.06154 | 5.7006e−14 | 0.251572 | 0.028083 | 23 | 23 | 17 | 0.003 |
| KDYR | CCCC | 12.5 | 1.4 | 21 | 9.714023 | 6.6677e−10 | 0.595238 | 0.066625 | 12 | 8 | 4 | 0.333 |
| VAxxNG | ECccCC | 21.6 | 2.4 | 46.6 | 12.56938 | 1.5977e−15 | 0.463519 | 0.052575 | 19 | 13 | 1 | 4.438 |
| NVAxK | EECcC | 24.2 | 2.7 | 48.5 | 13.32393 | 1.1195e−17 | 0.498969 | 0.056658 | 23 | 10 | 1 | 5.523 |
| YSxM | CCcE | 23.7 | 2.8 | 61.6 | 12.84049 | 3.5944e−16 | 0.38474 | 0.045127 | 25 | 24 | 2 | 5.861 |
| TPNR | CHHH | 22 | 2.6 | 54.2 | 12.38537 | 1.5783e−15 | 0.405904 | 0.047623 | 22 | 17 | 1 | 9.316 |
| GxxNS | CchHH | 25.9 | 3.1 | 66.8 | 13.3476 | 1.3878e−17 | 0.387725 | 0.045915 | 25 | 16 | 2 | 4.171 |
| FPExxT | HHHhhH | 14.2 | 1.7 | 58.9 | 9.754512 | 8.2132e−10 | 0.241087 | 0.028739 | 16 | 4 | 1 | 2 |
| DxRExG | EeEEcC | 14.2 | 1.7 | 48 | 9.784977 | 5.8536e−10 | 0.295833 | 0.035279 | 14 | 6 | 1 | 1.307 |
| YHxxNE | HHHhhH | 19.5 | 2.4 | 46.3 | 11.42206 | 2.0039e−13 | 0.421166 | 0.051197 | 20 | 20 | 7 | 6.268 |
| SxYxxE | ChHhhH | 23.4 | 2.9 | 60.5 | 12.39716 | 1.2306e−15 | 0.386777 | 0.047559 | 19 | 29 | 4 | 0.405 |
| MNIF | CCHH | 20.6 | 2.5 | 41.1 | 11.69437 | 2.3532e−14 | 0.501217 | 0.061842 | 20 | 6 | 1 | 7.935 |
| MDS | ECC | 25.5 | 3.2 | 83.9 | 12.7748 | 2.5660e−16 | 0.303933 | 0.037835 | 24 | 16 | 6 | 5.204 |
| GSxVE | CEeEE | 15.9 | 2 | 34.1 | 10.18649 | 3.2680e−11 | 0.466276 | 0.058124 | 17 | 10 | 1 | 1.048 |
| CKxxxT | CCcccC | 29.6 | 3.7 | 96.1 | 13.6757 | 1.2906e−18 | 0.308012 | 0.038755 | 30 | 17 | 4 | 6.006 |
| NPTxxE | CCChhH | 24.1 | 3 | 87.4 | 12.31285 | 1.9262e−15 | 0.275744 | 0.0347 | 25 | 27 | 2 | 3.167 |
| FxxxxQ | EcchhH | 21.5 | 2.7 | 95.3 | 11.59038 | 1.5552e−13 | 0.225603 | 0.028396 | 18 | 21 | 10 | 3.038 |
| MxxSR | HhhHC | 19.9 | 2.5 | 52.1 | 11.26099 | 2.7264e−13 | 0.381958 | 0.048106 | 24 | 12 | 3 | 2.21 |
| CGP | CHH | 24.5 | 3.1 | 61.6 | 12.50142 | 4.2984e−16 | 0.397727 | 0.050135 | 25 | 28 | 11 | 4.722 |
| KETxxA | CCChhH | 18.8 | 2.4 | 45.1 | 10.94829 | 1.1586e−12 | 0.416851 | 0.052675 | 21 | 22 | 9 | 3.218 |
| YHxxN | HHhhH | 50.5 | 6.5 | 81.8 | 18.01263 | 3.0622e−71 | 0.617359 | 0.07928 | 34 | 49 | 9 | 15.429 |
| QDKEG | HHHHC | 23.5 | 3 | 53.3 | 12.12891 | 1.5706e−15 | 0.440901 | 0.056696 | 22 | 22 | 1 | 4.063 |
| FPExL | HHHhH | 17.3 | 2.3 | 71.5 | 10.1722 | 5.1552e−11 | 0.241958 | 0.03158 | 19 | 8 | 2 | 5 |
| QxPxR | HcHhH | 18.2 | 2.4 | 55.2 | 10.48933 | 7.0720e−12 | 0.32971 | 0.043075 | 20 | 15 | 3 | 5.831 |
| PGPP | CCCC | 27.7 | 3.6 | 50.4 | 13.13769 | 1.2393e−18 | 0.549603 | 0.071817 | 6 | 23 | 5 | 0 |
| STM | CCE | 24.9 | 3.3 | 57 | 12.3273 | 3.1613e−16 | 0.436842 | 0.057314 | 26 | 26 | 2 | 4.792 |
| SxxYH | HhhHH | 55.1 | 7.3 | 104 | 18.27618 | 2.0986e−73 | 0.529808 | 0.070636 | 39 | 53 | 14 | 16.197 |
| STKVDK | CEEEEE | 54.6 | 7.3 | 226.6 | 17.8148 | 7.7075e−70 | 0.240953 | 0.032161 | 61 | 14 | 1 | 4.5 |
| KxVAxK | EeECcC | 15.3 | 2 | 42 | 9.504713 | 2.0057e−10 | 0.364286 | 0.048679 | 16 | 9 | 1 | 2.55 |
| VxxxQ | CehhH | 15.7 | 2.1 | 22.7 | 9.821201 | 2.0057e−11 | 0.69163 | 0.092986 | 11 | 16 | 5 | 0.045 |
| LGxxI | CCeeE | 20.7 | 2.8 | 133.5 | 10.8505 | 2.8269e−12 | 0.155056 | 0.020856 | 21 | 22 | 12 | 6.667 |
| VAxxxG | ECcccC | 36.9 | 5 | 129.3 | 14.59237 | 8.2210e−22 | 0.285383 | 0.038494 | 32 | 20 | 3 | 5.755 |
| MxxxxS | EecceE | 14.3 | 1.9 | 28.5 | 9.210245 | 6.8755e−10 | 0.501754 | 0.067857 | 14 | 14 | 10 | 0.5 |
| QxNxN | CeCcC | 17.6 | 2.4 | 31.2 | 10.22307 | 5.2458e−12 | 0.564103 | 0.07679 | 12 | 14 | 1 | 6 |
| ETGxS | ECCcC | 17.6 | 2.4 | 62 | 10.0008 | 6.3892e−11 | 0.283871 | 0.038748 | 20 | 13 | 1 | 6.266 |
| TxDxxR | CcHhhH | 16.8 | 2.3 | 45.8 | 9.81722 | 9.5154e−11 | 0.366812 | 0.050164 | 14 | 21 | 13 | 7.167 |
| ExGSS | EcCCC | 15.6 | 2.1 | 54 | 9.395607 | 8.4001e−10 | 0.288889 | 0.039586 | 20 | 15 | 2 | 3.386 |
| QxxNR | HchHH | 17.2 | 2.4 | 47.4 | 9.883211 | 4.7054e−11 | 0.362869 | 0.050001 | 18 | 13 | 1 | 5.818 |
| PGxxxL | CChhhC | 18.3 | 2.5 | 95.4 | 10.04912 | 5.2259e−11 | 0.191824 | 0.026518 | 20 | 12 | 4 | 1 |
| QFN | CEC | 25 | 3.5 | 41.7 | 12.09169 | 4.5918e−17 | 0.59952 | 0.082983 | 18 | 21 | 3 | 7 |
| NMxxxE | CCchhH | 27 | 3.8 | 79.7 | 12.25384 | 1.9659e−16 | 0.33877 | 0.047324 | 31 | 20 | 14 | 3.042 |
| NxRGxS | CeCCeC | 15.2 | 2.1 | 44 | 9.190897 | 9.0030e−10 | 0.345455 | 0.048322 | 17 | 14 | 1 | 4.851 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| WCG | CCH | 28.7 | 4 | 56.9 | 12.76874 | 3.8448e−18 | 0.504394 | 0.070649 | 27 | 30 | 12 | 5.694 |
| VAxKN | ECcCC | 20.9 | 2.9 | 46.7 | 10.8279 | 2.6347e−13 | 0.447537 | 0.062888 | 19 | 13 | 1 | 5.188 |
| NQTPN | HHCHH | 17.4 | 2.5 | 46.3 | 9.80733 | 5.7989e−11 | 0.37581 | 0.052976 | 17 | 12 | 1 | 5.818 |
| NxGY | EcCC | 21.7 | 3.1 | 58.1 | 10.9411 | 2.7368e−13 | 0.373494 | 0.05272 | 23 | 15 | 5 | 7.527 |
| DxPE | EhHH | 16.3 | 2.3 | 38.5 | 9.514759 | 1.5307e−10 | 0.423377 | 0.059793 | 19 | 11 | 2 | 2.167 |
| QxNxQ | EeCcC | 19.3 | 2.7 | 36.1 | 10.43716 | 9.0830e−13 | 0.534626 | 0.075549 | 17 | 19 | 2 | 1 |
| QDKxG | HHHhC | 27.2 | 3.9 | 57.3 | 12.29514 | 4.3110e−17 | 0.474695 | 0.067418 | 23 | 26 | 1 | 4.063 |
| GFTN | CCHH | 28.4 | 4 | 44.3 | 12.70299 | 6.0926e−19 | 0.641084 | 0.091314 | 26 | 19 | 1 | 5.255 |
| STVE | EEEE | 17 | 2.4 | 30 | 9.755365 | 1.1687e−11 | 0.566667 | 0.080927 | 19 | 12 | 2 | 1.048 |
| QDxEG | HHhHC | 26 | 3.7 | 53.3 | 11.93412 | 1.7775e−16 | 0.487805 | 0.070194 | 22 | 24 | 1 | 5.063 |
| LxxxYH | HhhhHH | 29.3 | 4.2 | 149.9 | 12.33288 | 2.6305e−16 | 0.195464 | 0.028332 | 29 | 32 | 9 | 6.747 |
| KSxW | CChH | 17.5 | 2.5 | 59.4 | 9.591293 | 1.6500e−10 | 0.294613 | 0.04278 | 20 | 12 | 3 | 3.333 |
| PxGPP | CcCCC | 18.4 | 2.7 | 56 | 9.854107 | 3.9241e−11 | 0.328571 | 0.047758 | 3 | 20 | 3 | 0 |
| NxAxK | EeCcC | 24.7 | 3.6 | 55.5 | 11.50343 | 4.7976e−15 | 0.445045 | 0.064834 | 24 | 11 | 2 | 5.523 |
| MxIF | CcHH | 24.6 | 3.6 | 56.8 | 11.45787 | 6.4773e−15 | 0.433099 | 0.063193 | 24 | 10 | 3 | 7.935 |
| GxLxL | CcCcH | 18.9 | 2.8 | 110.4 | 9.756476 | 8.9145e−11 | 0.171196 | 0.025321 | 17 | 19 | 16 | 0.071 |
| GxTVE | CeEEE | 19.5 | 2.9 | 45.9 | 10.09136 | 6.2818e−12 | 0.424837 | 0.062984 | 21 | 12 | 2 | 1.048 |
| ACxxG | CcccC | 42.2 | 6.3 | 122.4 | 14.73349 | 3.9997e−48 | 0.344771 | 0.051214 | 35 | 26 | 5 | 7.116 |
| NxxGxS | CecCeC | 18.6 | 2.8 | 49.7 | 9.784163 | 3.5481e−11 | 0.374245 | 0.055768 | 20 | 17 | 2 | 4.851 |
| ExxLxY | HhhHhC | 17 | 2.5 | 69.1 | 9.239619 | 4.0465e−10 | 0.24602 | 0.036788 | 23 | 21 | 13 | 6.077 |
| QxQxN | CcCeC | 16.7 | 2.5 | 32.4 | 9.345434 | 1.2978e−10 | 0.515432 | 0.077204 | 16 | 17 | 2 | 2 |
| TxNR | ChHH | 29 | 4.4 | 76.1 | 12.1332 | 6.1385e−17 | 0.381078 | 0.057443 | 28 | 24 | 7 | 11.983 |
| VxxKxG | EccCcC | 41.9 | 6.3 | 138.2 | 14.47502 | 1.6458e−46 | 0.303184 | 0.045794 | 40 | 22 | 7 | 9.791 |
| QxNT | CeCC | 22.2 | 3.4 | 31 | 10.89491 | 3.4768e−15 | 0.716129 | 0.108225 | 15 | 19 | 1 | 7 |
| DxxGNG | CccCCC | 30 | 4.5 | 174.5 | 12.11783 | 3.3659e−16 | 0.17192 | 0.025984 | 25 | 27 | 8 | 7 |
| FPxxLT | HHHhHH | 19.4 | 3 | 59.9 | 9.792754 | 2.7723e−11 | 0.323873 | 0.049478 | 22 | 8 | 1 | 3 |
| FxTN | EcCC | 19.5 | 3 | 66.8 | 9.782338 | 3.5580e−11 | 0.291916 | 0.044669 | 15 | 17 | 3 | 6 |
| NxTPN | HhCHH | 18.4 | 2.8 | 46.3 | 9.571722 | 5.2061e−11 | 0.397408 | 0.060928 | 18 | 13 | 1 | 5.818 |
| AxKNG | CcCCC | 22.6 | 3.5 | 59.6 | 10.54578 | 4.7755e−13 | 0.379195 | 0.058531 | 19 | 13 | 1 | 4.438 |
| DSVT | EEEE | 20.6 | 3.2 | 45.4 | 10.11567 | 2.6490e−12 | 0.453744 | 0.070644 | 24 | 23 | 2 | 1.283 |
| NTKVDK | CEEEEE | 28.8 | 4.5 | 135.4 | 11.72518 | 2.2882e−15 | 0.212703 | 0.032917 | 33 | 8 | 1 | 5.641 |
| QxKEG | HhHHC | 24.5 | 3.8 | 61.1 | 10.93374 | 4.3327e−14 | 0.400982 | 0.06247 | 23 | 23 | 2 | 4.063 |
| STKxDK | CEEeEE | 55.6 | 8.7 | 226.6 | 16.25592 | 1.6857e−58 | 0.245366 | 0.038248 | 61 | 14 | 1 | 4.5 |
| STKVxK | CEEEeE | 58.5 | 9.1 | 226.5 | 16.68499 | 1.4066e−61 | 0.258278 | 0.040286 | 65 | 17 | 1 | 4.5 |
| NQxPN | HHcHH | 21.5 | 3.4 | 47.3 | 10.21015 | 1.1585e−12 | 0.454545 | 0.071654 | 20 | 16 | 1 | 5.828 |
| GSTV | CEEE | 16.9 | 2.7 | 32.9 | 9.085333 | 1.8058e−10 | 0.513678 | 0.081151 | 18 | 11 | 1 | 1.048 |
| DxxxGS | HhhhCC | 20.9 | 3.3 | 65.1 | 9.930092 | 8.3751e−12 | 0.321045 | 0.050797 | 19 | 22 | 13 | 8.933 |
| YxxxxA | HhhccH | 22.8 | 3.6 | 74.5 | 10.28525 | 1.5427e−12 | 0.30604 | 0.048945 | 25 | 14 | 5 | 10.458 |
| SxKVDK | CEEEEE | 55.6 | 9 | 226.6 | 15.84846 | 1.0626e−55 | 0.245366 | 0.039728 | 62 | 15 | 1 | 4.5 |
| PPGxP | CCCcC | 24.9 | 4.1 | 88.4 | 10.60335 | 2.3088e−13 | 0.281674 | 0.045833 | 11 | 28 | 10 | 1.833 |
| GIPxxQ | CCChhH | 17.9 | 2.9 | 69.3 | 8.960881 | 6.8872e−10 | 0.258297 | 0.042109 | 17 | 17 | 2 | 5.263 |
| MDxS | ECcC | 19.5 | 3.2 | 92.2 | 9.295372 | 2.0562e−10 | 0.211497 | 0.034591 | 20 | 13 | 5 | 6.204 |
| NQTxN | HHChH | 17.4 | 2.9 | 46.3 | 8.87643 | 6.1701e−10 | 0.37581 | 0.061769 | 17 | 12 | 1 | 5.818 |
| WxGP | CcHH | 27.2 | 4.5 | 50.2 | 11.24573 | 5.9545e−16 | 0.541833 | 0.089269 | 25 | 30 | 10 | 4.972 |
| DGDxQ | CCCcC | 26.3 | 4.4 | 66.8 | 10.81102 | 2.3355e−14 | 0.393713 | 0.065788 | 29 | 17 | 3 | 1.25 |
| STxVDK | CEeEEE | 58.1 | 9.7 | 253.5 | 15.8352 | 1.1831e−55 | 0.229191 | 0.038304 | 65 | 14 | 1 | 5.5 |
| QxxTN | CecCC | 17.9 | 3 | 30.2 | 9.063858 | 5.9222e−11 | 0.592715 | 0.099349 | 13 | 15 | 1 | 6 |
| TKVDKK | EEEEEE | 65.1 | 11 | 336.5 | 16.6158 | 3.4212e−61 | 0.193462 | 0.032601 | 76 | 17 | 1 | 5.808 |
| PFxA | CCcH | 20.8 | 3.5 | 66.6 | 9.47604 | 3.8082e−11 | 0.312312 | 0.052751 | 22 | 13 | 9 | 8.396 |
| PPGP | CCCC | 25.6 | 4.3 | 82.9 | 10.4976 | 2.2505e−13 | 0.308806 | 0.052246 | 8 | 30 | 8 | 1 |
| SSTKVD | HCEEEE | 37.4 | 6.3 | 196.6 | 12.55329 | 3.0773e−35 | 0.190234 | 0.032272 | 49 | 12 | 1 | 4.5 |
| ISxxT | CChhH | 29.2 | 5 | 113.2 | 11.13658 | 6.9787e−15 | 0.257951 | 0.043782 | 27 | 28 | 14 | 8.2 |
| LxxNV | CchHH | 25.9 | 4.5 | 77.5 | 10.45325 | 1.5252e−13 | 0.334194 | 0.057583 | 22 | 19 | 4 | 1.542 |
| QSPxSL | EECcEE | 25 | 4.4 | 183.2 | 10.01805 | 2.8037e−12 | 0.136463 | 0.023753 | 32 | 15 | 2 | 3 |
| LxAxxR | CcHhhH | 23.3 | 4.1 | 144.3 | 9.678385 | 1.6775e−11 | 0.161469 | 0.028167 | 28 | 22 | 13 | 8.495 |
| GxxxxN | CechhH | 25.6 | 4.5 | 93.3 | 10.15598 | 8.5365e−13 | 0.274384 | 0.048505 | 29 | 24 | 4 | 4.774 |
| QxxxxI | EcceeE | 27.5 | 4.9 | 130.6 | 10.40287 | 2.8316e−13 | 0.210567 | 0.037539 | 31 | 37 | 19 | 7 |
| GFxN | CChH | 31.2 | 5.6 | 56.9 | 11.41646 | 2.1905e−29 | 0.54833 | 0.098116 | 29 | 24 | 3 | 5.26 |
| NxxC | EecC | 27.3 | 4.9 | 112.3 | 10.36205 | 2.4035e−13 | 0.243099 | 0.043545 | 26 | 14 | 2 | 5.944 |
| NxTxN | HhChH | 18.4 | 3.3 | 47.3 | 8.623012 | 6.9892e−10 | 0.389006 | 0.069712 | 18 | 13 | 1 | 5.818 |
| RxxxxD | EeceeE | 24 | 4.3 | 63.5 | 9.807516 | 1.3409e−12 | 0.377953 | 0.068037 | 23 | 29 | 16 | 6.716 |
| NxxGV | HhhCC | 22.3 | 4 | 70.5 | 9.365085 | 2.3344e−11 | 0.316312 | 0.057231 | 23 | 24 | 20 | 3.833 |
| RxxM | HhhE | 19.4 | 3.5 | 58.8 | 8.698453 | 5.2415e−10 | 0.329932 | 0.060173 | 21 | 12 | 2 | 5.157 |
| AExxxV | HhhhcC | 21.2 | 3.9 | 171 | 8.898036 | 3.9391e−10 | 0.123977 | 0.022677 | 27 | 29 | 25 | 6.033 |
| NxKVDK | CeEEEE | 29.8 | 5.5 | 135.3 | 10.62519 | 1.1533e−25 | 0.220251 | 0.040399 | 34 | 8 | 1 | 5.641 |
| GLxxxQ | CCchhH | 54.6 | 10 | 239.5 | 14.37632 | 3.6957e−46 | 0.227975 | 0.041884 | 60 | 66 | 48 | 3.069 |
| NTKxDK | CEEeEE | 28.8 | 5.3 | 135.4 | 10.41928 | 1.0158e−24 | 0.212703 | 0.039113 | 33 | 8 | 1 | 5.641 |
| LxxxxM | CchhhH | 61.6 | 11.4 | 519.5 | 15.05731 | 1.4748e−50 | 0.11853 | 0.021888 | 66 | 64 | 35 | 9.681 |
| FxxxxE | EcchhH | 34 | 6.3 | 182.6 | 11.21745 | 1.6197e−28 | 0.186199 | 0.034562 | 36 | 42 | 30 | 14.833 |
| SxKVxK | CeEEeE | 59.8 | 11.1 | 226.5 | 14.98264 | 4.7717e−50 | 0.264018 | 0.049037 | 67 | 18 | 1 | 4.5 |
| NTxVDK | CEeEEE | 28.8 | 5.4 | 135.9 | 10.34117 | 2.2370e−24 | 0.211921 | 0.039382 | 33 | 8 | 1 | 5.641 |
| KQxT | CEee | 26.1 | 4.9 | 50.9 | 10.13594 | 5.6397e−14 | 0.51277 | 0.095404 | 25 | 25 | 2 | 2.517 |
| QxxCS | HhhHH | 21.4 | 4 | 83.1 | 8.935147 | 1.8395e−10 | 0.257521 | 0.047998 | 23 | 13 | 5 | 5.023 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| SxKxDK | CeEeEE | 56.6 | 10.6 | 226.5 | 14.5105 | 5.1077e-47 | 0.24989 | 0.046621 | 62 | 15 | 1 | 4.5 |
| LxPxxR | CcHhhH | 39.9 | 7.4 | 228.2 | 12.08784 | 5.8061e-33 | 0.174847 | 0.032646 | 47 | 50 | 39 | 5.373 |
| STxVxK | CEeEeE | 64 | 12 | 256.9 | 15.41759 | 6.1069e-53 | 0.249124 | 0.046526 | 71 | 19 | 1 | 5.5 |
| GxPxxQ | CcChhH | 38.5 | 7.2 | 136.1 | 11.99353 | 1.9062e-32 | 0.28288 | 0.052856 | 41 | 40 | 19 | 6.991 |
| NPxxxE | CCchhH | 30.1 | 5.6 | 135.5 | 10.53919 | 2.7481e-25 | 0.22214 | 0.041521 | 33 | 35 | 8 | 6.167 |
| QTPN | HCHH | 22.1 | 4.1 | 46.3 | 9.249495 | 8.5114e-12 | 0.477322 | 0.089425 | 22 | 16 | 1 | 7.818 |
| ExGxS | EcCcC | 22.8 | 4.3 | 107 | 9.131379 | 8.1828e-11 | 0.213084 | 0.040032 | 25 | 20 | 3 | 6.266 |
| NTKVxK | CEEEeE | 29.8 | 5.6 | 135.4 | 10.43885 | 7.8103e-25 | 0.220089 | 0.041391 | 34 | 9 | 1 | 5.641 |
| LSxxxH | HHhhhH | 34.7 | 6.5 | 227.6 | 11.16265 | 2.8341e-28 | 0.15246 | 0.028772 | 35 | 37 | 13 | 8.872 |
| FPxxxT | HHhhhH | 22.4 | 4.2 | 81.3 | 9.076903 | 7.4347e-11 | 0.275523 | 0.052004 | 24 | 11 | 3 | 3 |
| RxxxxY | EecceE | 25.3 | 4.8 | 101.4 | 9.579866 | 5.9796e-12 | 0.249507 | 0.047384 | 25 | 27 | 18 | 8.5 |
| KxxxxY | EecceE | 31.7 | 6 | 126.7 | 10.69146 | 5.1661e-26 | 0.250197 | 0.047719 | 32 | 33 | 28 | 10.2 |
| GIxxxQ | CCchhH | 44.1 | 8.5 | 170 | 12.54746 | 1.8680e-35 | 0.259412 | 0.049891 | 38 | 36 | 14 | 7.463 |
| QxRxxE | CcChhH | 21.8 | 4.2 | 68.2 | 8.849948 | 1.4429e-10 | 0.319668 | 0.061734 | 24 | 25 | 8 | 2.818 |
| LCT | CCC | 29.6 | 5.8 | 90.5 | 10.25667 | 5.0074e-24 | 0.327072 | 0.063723 | 26 | 31 | 17 | 11.287 |
| PxVY | CeEE | 22.7 | 4.4 | 581 | 8.711344 | 7.2720e-10 | 0.039071 | 0.007627 | 33 | 23 | 9 | 4.01 |
| NPTE | CCCH | 21.3 | 4.2 | 69.4 | 8.654339 | 3.0076e-10 | 0.306916 | 0.060069 | 22 | 18 | 2 | 1 |
| STKxxK | CEEeeE | 60.5 | 11.8 | 226.5 | 14.52276 | 3.7939e-47 | 0.267108 | 0.052292 | 66 | 18 | 1 | 4.5 |
| MNxF | CChH | 25.2 | 4.9 | 62.4 | 9.506941 | 2.2013e-12 | 0.403846 | 0.079074 | 25 | 7 | 2 | 8.023 |
| NVxxK | EEccC | 25.3 | 5 | 66 | 9.489538 | 2.9209e-12 | 0.383333 | 0.075233 | 25 | 12 | 3 | 5.523 |
| KNVA | EEEC | 19.9 | 3.9 | 45.1 | 8.447256 | 4.0013e-10 | 0.441242 | 0.086907 | 21 | 17 | 1 | 4.181 |
| RxxxTD | HcccCC | 22.6 | 4.5 | 69.1 | 8.886497 | 9.5799e-11 | 0.327062 | 0.064487 | 29 | 27 | 6 | 7.032 |
| EAxxAE | HHhhHH | 21.2 | 4.2 | 95.4 | 8.498906 | 7.3395e-10 | 0.222222 | 0.043919 | 21 | 22 | 20 | 4.5 |
| VxxxNG | EcccCC | 29.1 | 5.8 | 121.9 | 9.97096 | 8.5736e-23 | 0.23872 | 0.047201 | 27 | 17 | 3 | 8.438 |
| RxxxD | HhheC | 21.4 | 4.2 | 67.2 | 8.614869 | 3.2608e-10 | 0.318452 | 0.063042 | 24 | 15 | 3 | 7.157 |
| FNT | ECC | 25.2 | 5 | 90.3 | 9.30099 | 1.1273e-11 | 0.27907 | 0.055319 | 20 | 22 | 4 | 8 |
| TKxDKK | EEeEEE | 66.1 | 13.1 | 336.4 | 14.92853 | 8.7974e-50 | 0.196492 | 0.038972 | 76 | 17 | 1 | 5.808 |
| SSxKVD | HCeEEE | 38.4 | 7.7 | 196.6 | 11.32751 | 3.8624e-29 | 0.19532 | 0.038973 | 50 | 13 | 1 | 4.5 |
| TKVxKK | EEEeEE | 65.1 | 13 | 336.5 | 14.73602 | 1.5202e-48 | 0.193462 | 0.038638 | 76 | 17 | 1 | 5.808 |
| PxxLxV | CceEeE | 32.3 | 6.5 | 409.9 | 10.15481 | 1.1669e-23 | 0.0788 | 0.015954 | 36 | 29 | 6 | 6 |
| YxxxNE | HhhhHH | 27.3 | 5.5 | 107.9 | 9.499449 | 8.3765e-21 | 0.253012 | 0.051287 | 28 | 30 | 14 | 7.268 |
| LSxxxQ | CChhhH | 25.1 | 5.2 | 186.8 | 8.90443 | 1.9586e-18 | 0.134368 | 0.027613 | 26 | 30 | 21 | 2.125 |
| KExxxA | CCchhH | 25.3 | 5.2 | 85.5 | 9.049696 | 5.5135e-19 | 0.295906 | 0.061241 | 26 | 26 | 10 | 3.377 |
| RxxDxD | HhhCcC | 36.6 | 7.6 | 188 | 10.735 | 2.5428e-26 | 0.194681 | 0.040444 | 32 | 30 | 9 | 4.792 |
| QxPxSL | EeCcEE | 27.9 | 5.8 | 253.4 | 9.267533 | 6.6594e-20 | 0.110103 | 0.022941 | 36 | 18 | 2 | 3.5 |
| SSTxVD | HCeEEE | 39.7 | 8.3 | 215.6 | 11.14276 | 2.7999e-28 | 0.184137 | 0.038369 | 52 | 13 | 1 | 5.5 |
| TxVDKK | EeEEEE | 68.9 | 14.4 | 363.1 | 14.63151 | 6.3100e-48 | 0.189755 | 0.039746 | 80 | 17 | 1 | 6.808 |
| QSPxxL | EECceE | 30.2 | 6.3 | 250.7 | 9.604652 | 2.6407e-21 | 0.120463 | 0.025266 | 39 | 21 | 3 | 3 |
| CxNG | CcCC | 44.4 | 9.3 | 177.5 | 11.79647 | 1.4799e-31 | 0.250041 | 0.052558 | 43 | 35 | 13 | 12.179 |
| DKEG | HHHC | 26.2 | 5.5 | 57.6 | 9.26898 | 7.4842e-20 | 0.454861 | 0.095656 | 26 | 26 | 3 | 4.063 |
| STKVD | CEEEE | 61.6 | 13 | 230.1 | 13.90479 | 2.1619e-43 | 0.26771 | 0.056344 | 67 | 19 | 1 | 5 |
| NxRG | CeCC | 26.1 | 5.5 | 50.1 | 9.307237 | 5.3638e-20 | 0.520958 | 0.109822 | 26 | 24 | 2 | 5.991 |
| NIF | CHH | 25.6 | 5.4 | 79.2 | 9.005026 | 8.0205e-19 | 0.323232 | 0.068183 | 25 | 10 | 3 | 11.435 |
| SSTKxD | HCEEeE | 37.9 | 8 | 196.6 | 10.78737 | 1.3832e-26 | 0.192777 | 0.040721 | 50 | 13 | 1 | 5.5 |
| SxYQ | ChHH | 24.4 | 5.2 | 78.1 | 8.742181 | 8.3452e-18 | 0.31242 | 0.066298 | 21 | 32 | 5 | 0.238 |
| QDxxG | HHhhC | 41.1 | 8.7 | 96 | 11.49502 | 5.3755e-30 | 0.428125 | 0.090888 | 33 | 39 | 7 | 6.563 |
| TKVDxK | EEEeEE | 65.5 | 14 | 338.5 | 14.09154 | 1.4697e-44 | 0.193501 | 0.041227 | 76 | 17 | 1 | 5.808 |
| LPxxxR | CChhhH | 31.2 | 6.7 | 201.9 | 9.644138 | 1.7359e-21 | 0.154532 | 0.033103 | 37 | 37 | 32 | 5 |
| NxKxDK | CeEeEE | 29.8 | 6.4 | 135.4 | 9.482096 | 8.5112e-21 | 0.220089 | 0.047229 | 34 | 8 | 1 | 5.641 |
| CKxG | CCcC | 51.5 | 11.1 | 173.9 | 12.55874 | 1.2519e-35 | 0.296147 | 0.063651 | 47 | 32 | 7 | 11.923 |
| VAxK | ECcC | 33.3 | 7.2 | 90.1 | 10.14773 | 1.2188e-23 | 0.369589 | 0.079833 | 30 | 14 | 1 | 6.435 |
| EGxxY | ECccC | 26.9 | 5.8 | 66.1 | 9.140516 | 2.2564e-19 | 0.406959 | 0.088175 | 25 | 23 | 3 | 9.785 |
| AxxxGV | HhhhCC | 45.2 | 9.8 | 582.5 | 11.38712 | 1.5163e-29 | 0.077597 | 0.016857 | 52 | 51 | 43 | 18.533 |
| QSxxSL | EEccEE | 25 | 5.4 | 183.2 | 8.519344 | 5.1349e-17 | 0.136463 | 0.029668 | 32 | 15 | 2 | 3 |
| QxxxxT | EecceE | 35.6 | 7.8 | 134.6 | 10.29844 | 2.4065e-24 | 0.264487 | 0.057628 | 35 | 41 | 27 | 8.758 |
| LxPxxQ | CcHhhH | 26.4 | 5.8 | 169.7 | 8.748374 | 6.9214e-18 | 0.155569 | 0.033949 | 32 | 36 | 24 | 1 |
| NVA | EEC | 38.6 | 8.4 | 107.2 | 10.80806 | 1.0942e-26 | 0.360075 | 0.07881 | 36 | 26 | 6 | 8.273 |
| GFxxxD | CCchhH | 35.3 | 7.7 | 175.1 | 10.14168 | 1.1664e-23 | 0.201599 | 0.044152 | 40 | 44 | 23 | 9.865 |
| SxxVDK | CeeEEE | 59.1 | 13.1 | 253.5 | 13.08031 | 1.3690e-38 | 0.233136 | 0.051524 | 66 | 15 | 1 | 5.5 |
| TNS | HHH | 28.8 | 6.4 | 113.7 | 9.14901 | 1.8584e-19 | 0.253298 | 0.056008 | 26 | 18 | 3 | 4.21 |
| QTxN | HChH | 22.1 | 4.9 | 48.3 | 8.202911 | 2.7740e-10 | 0.457557 | 0.10135 | 22 | 16 | 1 | 7.818 |
| GxTN | CcHH | 32.2 | 7.1 | 72.4 | 9.871338 | 1.9381e-22 | 0.444751 | 0.098713 | 31 | 24 | 4 | 6.255 |
| NTxVxK | CEeEeE | 29.8 | 6.7 | 140.9 | 9.196737 | 1.1483e-19 | 0.211498 | 0.047197 | 34 | 9 | 1 | 5.641 |
| ACK | CCC | 43.1 | 9.6 | 105.9 | 11.30227 | 4.3157e-29 | 0.406988 | 0.091043 | 41 | 25 | 9 | 11.66 |
| FxxxxY | CchhhC | 30.2 | 6.8 | 172.7 | 9.17886 | 1.3184e-19 | 0.17487 | 0.039245 | 33 | 31 | 6 | 11 |
| SxTKVD | HcEEEE | 55.5 | 12.5 | 313 | 12.41634 | 6.4044e-35 | 0.177316 | 0.039921 | 70 | 18 | 1 | 8.833 |
| IxxxxY | EcceeE | 25.5 | 5.7 | 229.8 | 8.350186 | 1.9949e-16 | 0.110966 | 0.024988 | 24 | 28 | 22 | 4.5 |
| NxKVxK | CeEEeE | 30.8 | 6.9 | 138.8 | 9.289826 | 4.7236e-20 | 0.221902 | 0.050018 | 35 | 9 | 1 | 5.641 |
| NxxPN | HhcHH | 25 | 5.6 | 53.4 | 8.621938 | 2.2460e-17 | 0.468165 | 0.105585 | 23 | 19 | 1 | 6.331 |
| WxxxxR | CchhhH | 33.4 | 7.5 | 151.7 | 9.659593 | 1.3620e-21 | 0.220171 | 0.049712 | 34 | 40 | 29 | 15.657 |
| ExxxxR | EecceE | 59.1 | 13.4 | 159.8 | 13.05759 | 1.8573e-38 | 0.369837 | 0.083731 | 54 | 72 | 45 | 12.861 |
| ACxN | CCcC | 23.9 | 5.4 | 105.8 | 8.125941 | 1.3307e-15 | 0.225898 | 0.051421 | 22 | 18 | 3 | 6.049 |
| GxSxxT | CcChhH | 25.9 | 5.9 | 139.5 | 8.40411 | 1.2643e-16 | 0.185663 | 0.042356 | 29 | 23 | 20 | 4.411 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| QxPxxL | EeCceE | 34.6 | 7.9 | 344 | 9.568532 | 3.0272e−21 | 0.100581 | 0.023093 | 45 | 26 | 4 | 4.5 |
| FxxxD | HhhhC | 60.3 | 13.9 | 504.8 | 12.62788 | 4.1362e−36 | 0.119453 | 0.027515 | 66 | 69 | 38 | 10.725 |
| PxxY | EhhH | 37.8 | 8.7 | 161.4 | 10.12745 | 1.2193e−23 | 0.234201 | 0.054011 | 42 | 43 | 23 | 13.599 |
| LxExxR | CcHhhH | 29.6 | 6.8 | 193.1 | 8.870479 | 2.0553e−18 | 0.153288 | 0.035373 | 38 | 40 | 33 | 4.292 |
| SxKxxK | CeEeeE | 64 | 14.8 | 237.7 | 13.17977 | 3.3609e−39 | 0.269247 | 0.062429 | 69 | 21 | 2 | 4.5 |
| DSxT | EEeE | 32.3 | 7.5 | 89 | 9.470465 | 8.5068e−21 | 0.362921 | 0.084184 | 35 | 37 | 12 | 4.36 |
| FPxxL | HHHhH | 39.1 | 9.1 | 187.5 | 10.21792 | 4.6988e−24 | 0.208533 | 0.048396 | 46 | 28 | 8 | 9.363 |
| AxxxGI | HhhhCC | 29.9 | 6.9 | 432.7 | 8.779901 | 4.3999e−18 | 0.069101 | 0.016053 | 42 | 42 | 39 | 8.841 |
| DxxGDG | CccCCC | 32.8 | 7.6 | 245.6 | 9.251579 | 6.0747e−20 | 0.13355 | 0.03109 | 31 | 37 | 12 | 4.958 |
| NQxP | HHcH | 28.5 | 6.6 | 58 | 9.017809 | 6.1701e−19 | 0.491379 | 0.114435 | 26 | 23 | 3 | 7.849 |
| QxPN | HcHH | 26.8 | 6.3 | 56.5 | 8.705318 | 1.0034e−17 | 0.474336 | 0.110806 | 26 | 21 | 2 | 7.828 |
| GxxL | HhhE | 23.9 | 5.6 | 86.1 | 7.996979 | 3.6702e−15 | 0.277584 | 0.065047 | 25 | 28 | 21 | 4.334 |
| FxxxxR | CchhhH | 53.8 | 12.6 | 341.3 | 11.80788 | 9.6778e−32 | 0.157633 | 0.036994 | 62 | 65 | 53 | 14.205 |
| ExxxxK | HchhhH | 29.4 | 6.9 | 82.3 | 8.942929 | 1.1236e−18 | 0.35723 | 0.083914 | 30 | 30 | 22 | 4 |
| GxxxxQ | CcehhH | 28.4 | 6.7 | 87.1 | 8.747114 | 6.3844e−18 | 0.326062 | 0.076678 | 29 | 37 | 15 | 3.502 |
| TKVDK | EEEEE | 86.3 | 20.3 | 363.4 | 15.07195 | 6.9306e−51 | 0.237479 | 0.055879 | 98 | 24 | 1 | 10.141 |
| LxxxxQ | CchhhH | 126.4 | 29.8 | 922.6 | 18.00717 | 4.5848e−72 | 0.137004 | 0.032258 | 140 | 158 | 106 | 19.556 |
| NQxxN | HHchH | 21.5 | 5.1 | 47.3 | 7.729667 | 3.3269e−14 | 0.454545 | 0.107054 | 20 | 16 | 1 | 5.828 |
| LxExxI | CcHhhH | 31.2 | 7.4 | 297.3 | 8.889427 | 1.6173e−18 | 0.104945 | 0.024787 | 39 | 26 | 16 | 5.375 |
| VAxxN | ECccC | 25.5 | 6.1 | 95.8 | 8.160134 | 9.3058e−16 | 0.26618 | 0.063248 | 25 | 18 | 4 | 7.188 |
| LxxxxR | CchhhH | 243 | 57.8 | 1351.9 | 24.88539 | 2.8521e−136 | 0.179747 | 0.042782 | 264 | 293 | 196 | 44.49 |
| PxNV | ChHH | 25.4 | 6.1 | 97.5 | 8.121634 | 1.2689e−15 | 0.260513 | 0.062064 | 23 | 28 | 9 | 3.542 |
| TQSPxS | EEECcE | 21.5 | 5.1 | 177.4 | 7.328957 | 6.0144e−13 | 0.121195 | 0.028944 | 26 | 14 | 2 | 2 |
| QxxxSL | EeccEE | 27.9 | 6.7 | 256.2 | 8.321559 | 2.2276e−16 | 0.108899 | 0.026065 | 36 | 18 | 2 | 3.5 |
| NxxVDK | CeeEEE | 29.8 | 7.1 | 135.8 | 8.714799 | 7.8056e−18 | 0.21944 | 0.052559 | 34 | 8 | 1 | 5.641 |
| AxxxxI | HhhhcC | 71.2 | 17.1 | 836.7 | 13.23487 | 1.3942e−39 | 0.085096 | 0.020406 | 94 | 92 | 85 | 17.263 |
| NxxHQ | HhhHH | 21.3 | 5.1 | 62.2 | 7.471413 | 2.2332e−13 | 0.342444 | 0.082215 | 19 | 23 | 10 | 7.166 |
| STxxDK | CEeeEE | 59.1 | 14.2 | 254.5 | 12.23358 | 5.4622e−34 | 0.23222 | 0.055962 | 65 | 14 | 1 | 5.5 |
| VxC | EcC | 60.4 | 14.6 | 326.9 | 12.28387 | 2.8734e−34 | 0.184766 | 0.044568 | 54 | 41 | 12 | 14.71 |
| STKxD | CEEeE | 64.9 | 15.7 | 230.1 | 12.88299 | 1.5164e−37 | 0.282051 | 0.0681 | 70 | 22 | 1 | 7 |
| PxxxSA | CceeEE | 21.1 | 5.1 | 180.5 | 7.181197 | 1.7416e−12 | 0.116898 | 0.028284 | 23 | 11 | 3 | 1.375 |
| NTKVD | CEEEE | 32.3 | 7.8 | 136.3 | 9.001505 | 5.8508e−19 | 0.236977 | 0.057495 | 38 | 10 | 1 | 5.641 |
| GVxF | CEeE | 20.8 | 5.1 | 180.9 | 7.100474 | 3.1004e−12 | 0.114981 | 0.027956 | 21 | 22 | 16 | 8.469 |
| DLxxxE | CCchhH | 30.3 | 7.4 | 187.5 | 8.615766 | 1.7599e−17 | 0.1616 | 0.039316 | 34 | 38 | 29 | 9.749 |
| SxKVD | CEEEE | 63.6 | 15.5 | 231.4 | 12.64685 | 3.0755e−36 | 0.274849 | 0.066994 | 68 | 21 | 1 | 5 |
| WxxxY | CchhH | 20.8 | 5.1 | 74 | 7.236102 | 1.2256e−12 | 0.281081 | 0.06854 | 19 | 33 | 14 | 8.479 |
| NTKxxK | CEEeeE | 29.8 | 7.3 | 135.5 | 8.59084 | 2.2286e−17 | 0.219926 | 0.053643 | 34 | 9 | 1 | 5.641 |
| RxxxxR | EecceE | 20.5 | 5 | 75.5 | 7.172686 | 1.9425e−12 | 0.271523 | 0.066234 | 20 | 25 | 19 | 3.583 |
| RxRxG | EcCC | 21.8 | 5.3 | 79.6 | 7.390263 | 3.8620e−13 | 0.273869 | 0.066905 | 22 | 25 | 19 | 4.833 |
| YHxxxE | HHHhhH | 23.2 | 5.7 | 128.6 | 7.516035 | 1.4229e−13 | 0.180404 | 0.044191 | 25 | 26 | 11 | 6.411 |
| SSxKxD | HCeEeE | 38.9 | 9.5 | 196.6 | 9.744738 | 4.9097e−22 | 0.197864 | 0.048527 | 51 | 14 | 1 | 5.5 |
| HxxNE | HhhHH | 36.8 | 9.1 | 122 | 9.582928 | 2.4752e−21 | 0.301639 | 0.074219 | 36 | 40 | 15 | 9.644 |
| LxDxxR | CcHhhH | 24.5 | 6 | 159 | 7.656071 | 4.7140e−14 | 0.154088 | 0.038 | 27 | 31 | 23 | 4.616 |
| NxTxxE | CcChhH | 54 | 13.3 | 264.7 | 11.43435 | 7.0416e−30 | 0.204005 | 0.05034 | 54 | 67 | 29 | 8.762 |
| TxVxKK | EeEeEE | 68.9 | 17 | 371.5 | 12.85896 | 1.8898e−37 | 0.185464 | 0.04588 | 80 | 17 | 1 | 6.808 |
| TKxDxK | EEeEeE | 66.5 | 16.5 | 338.4 | 12.64344 | 3.0096e−36 | 0.196513 | 0.04865 | 76 | 17 | 1 | 5.808 |
| RxxDxS | EccCcC | 20.5 | 5.1 | 138.7 | 6.97113 | 7.6462e−12 | 0.147801 | 0.036621 | 27 | 29 | 20 | 3.827 |
| QDKE | HHHH | 23.7 | 5.9 | 64 | 7.716774 | 3.1832e−14 | 0.370312 | 0.091796 | 22 | 22 | 1 | 4.063 |
| GxxF | EccE | 28.3 | 7 | 152 | 8.219089 | 5.0381e−16 | 0.186184 | 0.046217 | 30 | 34 | 19 | 9.566 |
| QSPxS | EECcE | 30.2 | 7.5 | 200.3 | 8.450279 | 7.0338e−17 | 0.150774 | 0.037434 | 37 | 20 | 3 | 3 |
| NLxxxD | CCchhH | 24.9 | 6.2 | 242.5 | 7.619062 | 6.0600e−14 | 0.10268 | 0.025522 | 26 | 29 | 21 | 11 |
| YxxxxP | EecceE | 23.8 | 5.9 | 118.9 | 7.53558 | 1.1961e−13 | 0.200168 | 0.049815 | 27 | 35 | 21 | 2.963 |
| LxExxK | CcHhhH | 24.2 | 6 | 184.2 | 7.523785 | 1.2703e−13 | 0.131379 | 0.032735 | 30 | 32 | 30 | 6.2 |
| MxIxE | CcHhH | 20.5 | 5.1 | 117.7 | 6.943104 | 9.2565e−12 | 0.174172 | 0.043553 | 25 | 14 | 9 | 8.328 |
| GxExF | CcCeE | 20.1 | 5 | 116.8 | 6.848623 | 1.7824e−11 | 0.172089 | 0.043222 | 24 | 21 | 4 | 4.684 |
| GxTxxQ | CcChhH | 51.1 | 12.8 | 261.6 | 10.9496 | 1.6032e−27 | 0.195336 | 0.049082 | 63 | 74 | 55 | 7.462 |
| ExxPxD | HhcCcC | 20.1 | 5.1 | 88.6 | 6.882766 | 1.4270e−11 | 0.226862 | 0.05714 | 20 | 24 | 16 | 2.25 |
| MNxxD | CChhH | 22.2 | 5.6 | 69.2 | 7.324761 | 6.0496e−13 | 0.320809 | 0.080818 | 17 | 23 | 13 | 3.584 |
| FNxN | ECcC | 20.7 | 5.2 | 107.5 | 6.950636 | 8.7080e−12 | 0.192558 | 0.04852 | 16 | 18 | 5 | 6 |
| NxCN | CcCC | 27.4 | 6.9 | 110.2 | 8.055912 | 1.9302e−15 | 0.248639 | 0.062659 | 28 | 34 | 10 | 5.048 |
| MxxxxP | EecceE | 21.2 | 5.3 | 84.5 | 7.081721 | 3.4833e−12 | 0.250888 | 0.063298 | 26 | 22 | 9 | 2.75 |
| FxxxxD | EcchhE | 20.7 | 5.2 | 160.7 | 6.880946 | 1.3823e−11 | 0.128811 | 0.032525 | 23 | 24 | 16 | 7.715 |
| RxxxPE | HhhcCC | 28.5 | 7.2 | 111.5 | 8.193404 | 6.1741e−16 | 0.255605 | 0.064712 | 30 | 27 | 22 | 3.901 |
| GSxxE | CEeeE | 20.3 | 5.1 | 75.4 | 6.918189 | 1.1167e−11 | 0.269231 | 0.068279 | 22 | 16 | 6 | 2.048 |
| NxAL | ChHH | 30.5 | 7.7 | 168.3 | 8.377216 | 1.2719e−16 | 0.181224 | 0.04598 | 30 | 33 | 27 | 6.667 |
| SxxVxK | CeeEeE | 65.3 | 16.6 | 303.8 | 12.30932 | 1.9144e−34 | 0.214944 | 0.054555 | 73 | 20 | 1 | 5.5 |
| RxxGxA | HhhCcC | 21.2 | 5.4 | 114.5 | 6.985745 | 6.6680e−12 | 0.185153 | 0.046994 | 27 | 33 | 21 | 2.833 |
| LTxxxK | CChhhH | 29.4 | 7.5 | 198.1 | 8.18312 | 6.3961e−16 | 0.14841 | 0.037688 | 33 | 33 | 28 | 5.063 |
| IxxxxR | CchhhH | 79.2 | 20.1 | 469.1 | 13.46389 | 5.9268e−41 | 0.168834 | 0.042888 | 88 | 90 | 67 | 14.891 |
| KNxA | EEeC | 20.4 | 5.2 | 50.6 | 7.054783 | 4.4588e−12 | 0.403162 | 0.102437 | 21 | 17 | 1 | 4.181 |
| SLxxE | CCchhH | 36.6 | 9.3 | 220.9 | 9.134791 | 1.5180e−19 | 0.165686 | 0.042167 | 41 | 46 | 29 | 5.65 |
| AxxSQ | HhhHC | 32.8 | 8.4 | 98.7 | 8.827817 | 2.6401e−18 | 0.33232 | 0.08479 | 33 | 27 | 10 | 3.798 |
| KxxxLD | HhccCC | 25.2 | 6.4 | 158 | 7.548711 | 1.0095e−13 | 0.159494 | 0.040754 | 29 | 27 | 16 | 3.182 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| VQxxxS | ECcccC | 25.7 | 6.6 | 164.8 | 7.619327 | 5.8468e-14 | 0.155947 | 0.03985 | 27 | 26 | 2 | 0.5 |
| FTN | CHH | 29.5 | 7.6 | 58.8 | 8.553956 | 3.1605e-17 | 0.501701 | 0.128453 | 27 | 20 | 1 | 5.263 |
| QxxEG | HhhHC | 34.9 | 8.9 | 104.9 | 9.07013 | 2.9112e-19 | 0.332698 | 0.085314 | 32 | 38 | 8 | 8.463 |
| GFT | CCH | 31.4 | 8.1 | 73.3 | 8.717496 | 7.2684e-18 | 0.428377 | 0.109906 | 30 | 23 | 3 | 5.255 |
| GxDxxQ | CcChhH | 29 | 7.4 | 147.4 | 8.106973 | 1.1979e-15 | 0.196744 | 0.05051 | 30 | 28 | 20 | 7.667 |
| LTxxxR | CChhhH | 30.4 | 7.8 | 203.9 | 8.238198 | 3.9476e-16 | 0.149093 | 0.038329 | 33 | 36 | 29 | 3.333 |
| DxEG | HhhHC | 38.2 | 9.8 | 91.3 | 9.586215 | 2.3137e-21 | 0.418401 | 0.107564 | 37 | 43 | 13 | 7.397 |
| NAxxxQ | HHHhhH | 20.6 | 5.3 | 129.5 | 6.788754 | 2.5681e-11 | 0.159073 | 0.040908 | 19 | 23 | 16 | 8 |
| QSxxxL | EEcceE | 30.2 | 7.8 | 260.2 | 8.169296 | 6.9027e-16 | 0.116065 | 0.029863 | 39 | 21 | 3 | 3 |
| GxSxxA | EeEE | 30.1 | 7.8 | 260.9 | 8.142754 | 8.5659e-16 | 0.11537 | 0.029738 | 32 | 35 | 28 | 9.081 |
| TVxxxE | CHhhhH | 24.2 | 6.2 | 110.1 | 7.40446 | 3.0474e-13 | 0.2198 | 0.056658 | 26 | 20 | 19 | 5 |
| SKxxH | HHHhH | 34 | 8.8 | 105.4 | 8.902407 | 1.3189e-18 | 0.322581 | 0.083153 | 32 | 43 | 14 | 6.807 |
| CxP | ChH | 38.6 | 10 | 195.9 | 9.318972 | 2.6851e-20 | 0.197039 | 0.050815 | 41 | 47 | 21 | 8.789 |
| YxxEN | HhhHH | 47.1 | 12.1 | 158.4 | 10.43551 | 4.0653e-25 | 0.297348 | 0.076699 | 47 | 58 | 23 | 3.68 |
| YxxxxE | EechhH | 27.5 | 7.1 | 135.1 | 7.864945 | 8.4555e-15 | 0.203553 | 0.052558 | 32 | 28 | 16 | 4.787 |
| SxSxxA | CcChhH | 28.4 | 7.3 | 190 | 7.931919 | 4.8305e-15 | 0.149474 | 0.038609 | 34 | 33 | 18 | 4.015 |
| SxxGL | HhhCC | 27.2 | 7 | 120.2 | 7.839361 | 1.0445e-14 | 0.22629 | 0.058491 | 31 | 36 | 27 | 3.572 |
| DxAxxQ | ChHhhH | 30.4 | 7.9 | 151.2 | 8.256938 | 3.4079e-16 | 0.201058 | 0.051986 | 32 | 39 | 30 | 5.433 |
| ExxxxY | EcceeE | 29.7 | 7.7 | 170.1 | 8.125602 | 1.0025e-15 | 0.174603 | 0.045189 | 32 | 34 | 27 | 6.45 |
| ExDxxG | HhCccC | 20.8 | 5.4 | 144.5 | 6.752501 | 3.2182e-11 | 0.143945 | 0.037384 | 18 | 19 | 7 | 4 |
| RxKxG | EcCcC | 27.1 | 7.1 | 109.2 | 7.781732 | 1.6320e-14 | 0.248168 | 0.064822 | 25 | 28 | 18 | 11.209 |
| TxVDxK | EeEEeE | 69.3 | 18.1 | 368.2 | 12.32308 | 1.5043e-34 | 0.188213 | 0.049248 | 80 | 17 | 1 | 6.808 |
| GxxxxF | EecceE | 33.3 | 8.7 | 334 | 8.43651 | 6.9899e-17 | 0.099701 | 0.026101 | 45 | 60 | 8 | 3.924 |
| CKN | CCC | 43.3 | 11.3 | 142.4 | 9.894711 | 1.0185e-22 | 0.304073 | 0.079616 | 39 | 34 | 8 | 12.606 |
| YxxxE | EchhH | 25.1 | 6.6 | 100 | 7.466048 | 1.8730e-13 | 0.251 | 0.06584 | 25 | 29 | 20 | 7.899 |
| AxxxxV | HhhhcC | 87.4 | 23 | 1099.8 | 13.58946 | 9.7121e-42 | 0.079469 | 0.020879 | 114 | 119 | 101 | 28.431 |
| LSxxY | HHhhH | 44.5 | 11.7 | 344 | 9.754079 | 3.7941e-22 | 0.12936 | 0.034022 | 37 | 45 | 14 | 7.408 |
| TKVxK | EEEeE | 92.3 | 24.5 | 367.4 | 14.17006 | 3.0926e-45 | 0.251225 | 0.066733 | 105 | 29 | 1 | 10.141 |
| DxxRN | HhhHC | 24.5 | 6.5 | 74.9 | 7.38053 | 3.6042e-13 | 0.327103 | 0.086891 | 26 | 24 | 19 | 6.5 |
| SSTKV | HCEEE | 41.4 | 11 | 198.1 | 9.427547 | 9.0951e-21 | 0.208985 | 0.055556 | 52 | 15 | 1 | 4.536 |
| GVxxxE | CChhH | 38.3 | 10.2 | 238.7 | 8.992735 | 5.1079e-19 | 0.160452 | 0.042731 | 43 | 51 | 37 | 5.901 |
| ExxNS | HhhHC | 18.8 | 5 | 57.3 | 6.447436 | 2.5887e-10 | 0.328098 | 0.087466 | 18 | 21 | 16 | 3 |
| DxDxT | CcCcE | 20.6 | 5.5 | 97.6 | 6.635209 | 7.0133e-11 | 0.211066 | 0.05628 | 18 | 21 | 8 | 6.515 |
| NLY | CHH | 19.2 | 5.1 | 58 | 6.509825 | 1.7088e-10 | 0.331034 | 0.088392 | 18 | 20 | 17 | 3 |
| YxGD | EeCC | 25.4 | 6.8 | 119.1 | 7.343589 | 4.4620e-13 | 0.213266 | 0.057113 | 29 | 28 | 21 | 7.501 |
| SxxWPS | CccCCC | 19.8 | 5.3 | 162.2 | 6.396654 | 3.2879e-10 | 0.122072 | 0.032719 | 23 | 22 | 1 | 4 |
| ELxxxE | CCchhH | 27.3 | 7.3 | 172.9 | 7.544366 | 9.5073e-14 | 0.157895 | 0.042349 | 28 | 29 | 21 | 2 |
| SxTxVD | HcEeEE | 57.7 | 15.5 | 332.4 | 10.97081 | 1.1028e-27 | 0.173586 | 0.046666 | 73 | 19 | 1 | 9.833 |
| TxxDKK | EeeEEE | 69.9 | 18.8 | 364 | 12.10562 | 2.0737e-33 | 0.192033 | 0.05163 | 80 | 17 | 1 | 6.808 |
| SAGT | CCCC | 18.8 | 5.1 | 65.4 | 6.36097 | 4.4071e-10 | 0.287462 | 0.077343 | 20 | 24 | 9 | 6.286 |
| NPxE | CCcH | 23.8 | 6.4 | 92.8 | 7.124827 | 2.2574e-12 | 0.256466 | 0.069004 | 25 | 21 | 5 | 1 |
| TQxPxS | EEeCcE | 25.8 | 6.9 | 245.4 | 7.260776 | 7.8442e-13 | 0.105134 | 0.028289 | 32 | 17 | 2 | 2.5 |
| DxSV | EeEE | 19.1 | 5.1 | 128.3 | 6.281303 | 6.9655e-10 | 0.14887 | 0.040088 | 22 | 19 | 16 | 2.25 |
| GVxxxD | CCchhH | 23.4 | 6.3 | 189.3 | 6.92795 | 8.7577e-12 | 0.123613 | 0.033287 | 24 | 27 | 22 | 6.057 |
| QxxxxT | CccecC | 24.6 | 6.6 | 81.9 | 7.279091 | 7.3895e-13 | 0.300366 | 0.080963 | 28 | 27 | 10 | 2.904 |
| RxxxxT | EecceE | 23.5 | 6.4 | 116.1 | 6.994801 | 5.5755e-12 | 0.202412 | 0.054742 | 20 | 27 | 19 | 8.114 |
| YxxxNR | EcccEE | 19.8 | 5.4 | 85.3 | 6.438949 | 2.5510e-10 | 0.232122 | 0.062882 | 21 | 18 | 2 | 4.356 |
| NKxG | HHhC | 32.2 | 8.7 | 87.3 | 8.377682 | 1.2095e-16 | 0.368843 | 0.099933 | 33 | 36 | 27 | 4.271 |
| CxH | ChH | 22.2 | 6 | 117.7 | 6.772808 | 2.6270e-11 | 0.188615 | 0.051121 | 24 | 22 | 17 | 5 |
| NVM | HHH | 22.3 | 6 | 170.9 | 6.72985 | 3.4499e-11 | 0.130486 | 0.035381 | 22 | 16 | 4 | 3.542 |
| ExxI | HhhE | 29.5 | 8 | 120.6 | 7.861338 | 8.0506e-15 | 0.24461 | 0.06639 | 31 | 36 | 25 | 5.111 |
| STxVD | CEeEE | 66.1 | 17.9 | 259 | 11.78422 | 9.9807e-32 | 0.255212 | 0.069278 | 72 | 20 | 1 | 6 |
| KVDKK | EEEEE | 71.2 | 19.4 | 341.6 | 12.13106 | 1.4989e-33 | 0.208431 | 0.056672 | 81 | 22 | 1 | 5.808 |
| SGxW | CCcE | 20.7 | 5.6 | 91.2 | 6.551699 | 1.1925e-10 | 0.226974 | 0.06179 | 21 | 23 | 18 | 7.5 |
| NTxxDK | CEeeEE | 28.8 | 7.8 | 135.9 | 7.708178 | 2.6509e-14 | 0.211921 | 0.057719 | 33 | 8 | 1 | 5.641 |
| DxVT | EeEE | 24.9 | 6.8 | 171 | 7.088115 | 2.7435e-12 | 0.145614 | 0.039734 | 31 | 34 | 9 | 1.708 |
| YNN | ECC | 19.7 | 5.4 | 60.5 | 6.472367 | 2.0995e-10 | 0.32562 | 0.088854 | 17 | 26 | 9 | 6.123 |
| PxTxxQ | CcChhH | 21.7 | 5.9 | 173.7 | 6.591601 | 8.7031e-11 | 0.124928 | 0.034126 | 30 | 33 | 20 | 5.625 |
| GxxGF | HhhCC | 22.1 | 6 | 100.2 | 6.742831 | 3.2248e-11 | 0.220559 | 0.060261 | 29 | 16 | 6 | 4.26 |
| LDxxxR | CChhhH | 32.5 | 8.9 | 240.5 | 8.068869 | 1.4172e-15 | 0.135135 | 0.036966 | 38 | 32 | 13 | 6.644 |
| NxKVD | CeEEE | 34.1 | 9.4 | 138.3 | 8.361157 | 1.2840e-16 | 0.246565 | 0.067811 | 41 | 12 | 1 | 5.641 |
| STxxK | CEeeeE | 68 | 18.7 | 273.9 | 11.80545 | 7.5425e-32 | 0.248266 | 0.06831 | 74 | 22 | 3 | 5.5 |
| ExxHD | HhhHH | 21.8 | 6 | 82.4 | 6.70029 | 4.3412e-11 | 0.264563 | 0.072797 | 21 | 22 | 13 | 5.667 |
| DxNxY | CcCcE | 20.3 | 5.6 | 84.7 | 6.441134 | 2.4504e-10 | 0.239663 | 0.065956 | 24 | 17 | 7 | 1.375 |
| DxxGxP | HhhCcC | 33.8 | 9.3 | 183 | 8.241246 | 3.4292e-16 | 0.184699 | 0.050855 | 38 | 39 | 19 | 4.333 |
| SxxxxN | CceccE | 20.4 | 5.6 | 67.2 | 6.515335 | 1.5374e-10 | 0.303571 | 0.083593 | 25 | 26 | 5 | 5.606 |
| FxxM | ChhH | 32.3 | 8.9 | 164.3 | 8.052618 | 1.6312e-15 | 0.196592 | 0.054268 | 37 | 32 | 17 | 8.547 |
| SPSSL | ECCEE | 22.6 | 6.2 | 113.2 | 6.737919 | 3.2449e-11 | 0.199647 | 0.05512 | 25 | 10 | 1 | 0 |
| WxxxxT | HhhccC | 21.1 | 5.8 | 171.2 | 6.436797 | 2.3915e-10 | 0.123248 | 0.034041 | 27 | 24 | 20 | 3.9 |
| ESY | EEE | 19.3 | 5.3 | 85.3 | 6.240198 | 8.9001e-10 | 0.22626 | 0.062595 | 17 | 20 | 10 | 8.5 |
| SxTKxD | HcEEeE | 56 | 15.5 | 313 | 10.55562 | 9.5006e-26 | 0.178914 | 0.049499 | 71 | 19 | 1 | 9.833 |
| VxxKN | EccCC | 29.4 | 8.2 | 105.5 | 7.747512 | 1.9363e-14 | 0.278673 | 0.077267 | 28 | 18 | 3 | 8.188 |
| GxxxDF | EeccEE | 25.3 | 7 | 248.3 | 6.995039 | 5.0997e-12 | 0.101893 | 0.028291 | 34 | 35 | 3 | 0 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| RxxxTG | EeccCC | 24.8 | 6.9 | 127.8 | 7.018198 | 4.4794e−12 | 0.194053 | 0.053883 | 30 | 33 | 18 | 1.284 |
| VxxGA | HhcCC | 33.4 | 9.3 | 235.9 | 8.076537 | 1.2963e−15 | 0.141585 | 0.039348 | 39 | 40 | 37 | 4.283 |
| QxPxS | EeCcE | 34.5 | 9.6 | 273.2 | 8.163922 | 6.2295e−16 | 0.126281 | 0.035226 | 43 | 23 | 3 | 3.5 |
| LxxxxK | CchhH | 149.3 | 41.7 | 947.4 | 17.0475 | 7.0481e−65 | 0.157589 | 0.043999 | 173 | 204 | 157 | 23.953 |
| SxAxxR | ChHhhH | 47.9 | 13.4 | 257.1 | 9.69243 | 6.3584e−22 | 0.186309 | 0.052044 | 49 | 50 | 24 | 4.47 |
| ExxxxL | EecceE | 40.3 | 11.3 | 277.3 | 8.826998 | 2.0686e−18 | 0.14533 | 0.040651 | 35 | 41 | 22 | 9.5 |
| YxxxxY | EcceeE | 26 | 7.3 | 256.4 | 7.038223 | 3.6866e−12 | 0.101404 | 0.028396 | 31 | 34 | 24 | 10.368 |
| NxSxxD | CcChhH | 25.1 | 7 | 145.6 | 6.979942 | 5.7351e−12 | 0.17239 | 0.048331 | 28 | 28 | 22 | 4.334 |
| PGxxA | CChhH | 28.5 | 8 | 157.5 | 7.44514 | 1.8844e−13 | 0.180952 | 0.050747 | 32 | 27 | 20 | 2.951 |
| LSxxxI | CChhhH | 25.4 | 7.1 | 404.3 | 6.907684 | 9.1681e−12 | 0.062825 | 0.017623 | 27 | 30 | 22 | 3.343 |
| PNR | HHH | 26.3 | 7.4 | 104.2 | 7.227147 | 9.8791e−13 | 0.252399 | 0.070802 | 28 | 23 | 6 | 10.321 |
| FxxEE | HhhHH | 21.3 | 6 | 123.9 | 6.403548 | 2.9275e−10 | 0.171913 | 0.048423 | 23 | 25 | 19 | 5.976 |
| RxHG | HhHC | 25.6 | 7.2 | 82.9 | 7.166051 | 1.5713e−12 | 0.308806 | 0.086994 | 32 | 33 | 30 | 6.25 |
| QxxxxL | EecceE | 42.9 | 12.1 | 459.9 | 8.96776 | 5.6147e−19 | 0.093281 | 0.026328 | 53 | 36 | 12 | 5.5 |
| RxxxGL | HhhhCC | 28.6 | 8.1 | 176.7 | 7.393568 | 2.7275e−13 | 0.161856 | 0.045701 | 32 | 34 | 21 | 5.7 |
| GLxxxE | CCchhH | 55.6 | 15.7 | 370.9 | 10.28661 | 1.5314e−24 | 0.149906 | 0.042345 | 55 | 64 | 53 | 14.726 |
| DxxRG | CceCC | 21.2 | 6 | 58.3 | 6.559553 | 1.1201e−10 | 0.363636 | 0.102768 | 24 | 19 | 1 | 4.782 |
| YxxxxK | EecceE | 23.2 | 6.6 | 106.7 | 6.708479 | 3.8350e−11 | 0.217432 | 0.061457 | 25 | 30 | 21 | 4.75 |
| FxxS | ChhH | 46.5 | 13.2 | 250.8 | 9.432711 | 7.6287e−21 | 0.185407 | 0.052529 | 51 | 43 | 21 | 7.676 |
| TQxG | HHcC | 23.6 | 6.7 | 73 | 6.85765 | 1.4179e−11 | 0.323288 | 0.091676 | 26 | 32 | 21 | 3.847 |
| SxKxD | CeEeE | 66.9 | 19 | 237.4 | 11.47017 | 3.6870e−30 | 0.281803 | 0.079926 | 71 | 24 | 1 | 7 |
| SxxWxS | CccCcC | 23.6 | 6.7 | 200.2 | 6.644325 | 5.6746e−11 | 0.117882 | 0.033448 | 26 | 26 | 4 | 6 |
| VPS | CHH | 23.5 | 6.7 | 71.3 | 6.843087 | 1.5709e−11 | 0.329593 | 0.093573 | 20 | 23 | 13 | 6 |
| FxxxLT | HhhhHH | 24 | 6.8 | 425 | 6.631623 | 6.0285e−11 | 0.056471 | 0.016048 | 27 | 14 | 6 | 5.5 |
| SSTxxD | HCEeeE | 40.2 | 11.4 | 216.6 | 8.739729 | 4.4322e−18 | 0.185596 | 0.052797 | 53 | 14 | 1 | 6.5 |
| YDY | CCE | 24.7 | 7 | 113 | 6.871379 | 1.2210e−11 | 0.218584 | 0.062322 | 22 | 28 | 12 | 4.25 |
| LSxxxR | CChhhH | 40.4 | 11.5 | 293.2 | 8.662063 | 8.5519e−18 | 0.13779 | 0.039389 | 48 | 58 | 43 | 12.646 |
| EQF | CEE | 23.4 | 6.7 | 79.4 | 6.738533 | 3.1440e−11 | 0.29471 | 0.084441 | 26 | 26 | 4 | 4.684 |
| TxVDK | EeEEE | 90 | 25.8 | 396 | 13.07771 | 8.3835e−39 | 0.227273 | 0.065121 | 102 | 24 | 1 | 11.141 |
| ETxS | ECcC | 29.2 | 8.4 | 99.1 | 7.526295 | 1.0238e−13 | 0.294652 | 0.084439 | 27 | 26 | 9 | 13.54 |
| LxxGY | HhcCC | 25.2 | 7.2 | 158.7 | 6.845655 | 1.4142e−11 | 0.15879 | 0.045521 | 24 | 29 | 23 | 9.094 |
| TKVxxK | EEEeeE | 66 | 18.9 | 393 | 11.08834 | 2.6474e−28 | 0.167939 | 0.048171 | 77 | 18 | 2 | 5.808 |
| IAxxG | HHhhC | 23.8 | 6.8 | 183.8 | 6.617026 | 6.7222e−11 | 0.129489 | 0.037163 | 25 | 31 | 22 | 2.501 |
| LxxxGV | HhhhCC | 23 | 6.6 | 445.9 | 6.430108 | 2.2726e−10 | 0.051581 | 0.014805 | 27 | 29 | 25 | 6.833 |
| YxxM | CccC | 28.9 | 8.3 | 165.3 | 7.338177 | 4.0315e−13 | 0.174834 | 0.050202 | 31 | 30 | 8 | 7.862 |
| MxxxxY | CchhhH | 22.2 | 6.4 | 219.9 | 6.355883 | 3.7539e−10 | 0.100955 | 0.029014 | 23 | 26 | 20 | 2 |
| NxxxxT | EccccE | 26.5 | 7.6 | 179.9 | 6.984374 | 5.2547e−12 | 0.147304 | 0.04239 | 30 | 37 | 20 | 12.06 |
| TxAxxK | ChHhhH | 33.7 | 9.7 | 179.1 | 7.910811 | 4.7461e−15 | 0.188163 | 0.054259 | 35 | 37 | 26 | 11.06 |
| WxxxxE | HhhhcC | 38.8 | 11.2 | 266.7 | 8.429782 | 6.3105e−17 | 0.145482 | 0.041973 | 47 | 49 | 29 | 6.095 |
| PxSS | EhHH | 21.2 | 6.1 | 94.8 | 6.304806 | 5.4447e−10 | 0.223629 | 0.064531 | 24 | 25 | 4 | 3.333 |
| TKxDK | EEeEE | 87.3 | 25.2 | 364.3 | 12.81001 | 2.7096e−37 | 0.239638 | 0.069249 | 98 | 24 | 1 | 10.141 |
| QxKxG | HhHhC | 36 | 10.4 | 188.4 | 8.142734 | 7.1133e−16 | 0.191083 | 0.055388 | 34 | 36 | 11 | 5.063 |
| SxxKVD | HceEEE | 56.5 | 16.4 | 313 | 10.17234 | 4.8080e−24 | 0.180511 | 0.052395 | 71 | 19 | 1 | 8.833 |
| IDxS | ECcE | 41.4 | 12 | 221.9 | 8.712627 | 5.4346e−18 | 0.186571 | 0.054175 | 49 | 41 | 2 | 4.361 |
| PTxxxL | CChhhH | 23 | 6.7 | 322.9 | 6.377182 | 3.1697e−10 | 0.071229 | 0.0207 | 23 | 22 | 12 | 4.833 |
| FxxH | CccH | 21 | 6.1 | 86.6 | 6.254237 | 7.5023e−10 | 0.242494 | 0.070478 | 21 | 16 | 10 | 0.021 |
| LxxxxP | EecceE | 22.6 | 6.6 | 152.9 | 6.393634 | 2.9287e−10 | 0.147809 | 0.042963 | 25 | 27 | 20 | 4.5 |
| RxxxxE | EecceE | 36.6 | 10.6 | 131.4 | 8.30223 | 1.9387e−16 | 0.278539 | 0.080969 | 44 | 52 | 39 | 10.524 |
| QTxxxK | HHHhhH | 25.6 | 7.4 | 144 | 6.832254 | 1.5255e−11 | 0.177778 | 0.051705 | 24 | 28 | 17 | 4.636 |
| LxxxxV | HccceE | 24.2 | 7 | 365.7 | 6.531652 | 1.1388e−10 | 0.066174 | 0.019247 | 26 | 26 | 21 | 4.9 |
| DxNxE | CcChH | 25.1 | 7.3 | 128.5 | 6.781685 | 2.1820e−11 | 0.195331 | 0.056827 | 25 | 31 | 20 | 4.226 |
| TxTxxE | CcChhH | 30.8 | 9 | 191.4 | 7.468604 | 1.4651e−13 | 0.16092 | 0.046846 | 35 | 33 | 29 | 6.084 |
| TKxxKK | EEeeEE | 66.1 | 19.3 | 341.6 | 10.99212 | 7.5992e−28 | 0.193501 | 0.056354 | 76 | 17 | 1 | 5.808 |
| MNxxE | CChhH | 44.6 | 13 | 167.5 | 9.123343 | 1.3666e−19 | 0.266269 | 0.077633 | 46 | 33 | 16 | 9.479 |
| ExxxxR | EcceeE | 39.2 | 11.5 | 139.1 | 8.542044 | 2.4730e−17 | 0.281812 | 0.082523 | 39 | 47 | 29 | 4.741 |
| ANxxN | HHHhH | 26.8 | 7.9 | 128.3 | 6.978653 | 5.4345e−12 | 0.208885 | 0.061203 | 29 | 34 | 25 | 6.133 |
| NxxxxW | CccccE | 25.7 | 7.5 | 182.6 | 6.748517 | 2.6433e−11 | 0.140745 | 0.041333 | 26 | 33 | 18 | 9.452 |
| ExxGxS | HhcCcC | 24.9 | 7.3 | 129.6 | 6.68272 | 4.2194e−11 | 0.19213 | 0.056545 | 27 | 30 | 23 | 9.63 |
| QxxxxM | CcchhH | 24.2 | 7.1 | 154 | 6.5474 | 1.0378e−10 | 0.157143 | 0.046288 | 27 | 21 | 12 | 1.75 |
| ExxGxS | HhhCcC | 35.4 | 10.4 | 185.6 | 7.959755 | 3.0861e−15 | 0.190733 | 0.056187 | 37 | 39 | 35 | 7.367 |
| VxxxxF | CchhhH | 40.9 | 12.1 | 688.2 | 8.38324 | 8.7602e−17 | 0.05943 | 0.017513 | 51 | 68 | 39 | 16.33 |
| LSxxxK | CChhhH | 29.4 | 8.7 | 241 | 7.163028 | 1.3727e−12 | 0.121992 | 0.036016 | 33 | 42 | 31 | 5.338 |
| MNI | CCH | 22.6 | 6.7 | 70.6 | 6.475222 | 1.7836e−10 | 0.320113 | 0.094588 | 23 | 9 | 4 | 8.685 |
| GxSxxE | CcChhH | 92.3 | 27.3 | 563.9 | 12.76202 | 4.6873e−37 | 0.163682 | 0.048374 | 106 | 122 | 100 | 25.005 |
| SxxxDK | CeeeEE | 60.1 | 17.8 | 256.6 | 10.37493 | 5.7844e−25 | 0.234217 | 0.069505 | 66 | 15 | 1 | 5.5 |
| NxAxxK | ChHhhH | 23.7 | 7.1 | 137.1 | 6.437742 | 2.1271e−10 | 0.172867 | 0.051429 | 26 | 30 | 19 | 6.25 |
| SPxSL | ECcEE | 42.9 | 12.8 | 185.7 | 8.74043 | 4.1484e−18 | 0.231018 | 0.068739 | 49 | 26 | 2 | 4 |
| QxTG | HhHC | 36.3 | 10.8 | 146.5 | 8.059476 | 1.3787e−15 | 0.247782 | 0.073749 | 40 | 36 | 23 | 9.267 |
| NxKxxK | CeEeeE | 32.2 | 9.6 | 154 | 7.535957 | 8.5785e−14 | 0.209091 | 0.062307 | 37 | 12 | 3 | 5.641 |
| NTKxD | CEEeE | 32.3 | 9.6 | 139.1 | 7.572258 | 6.5452e−14 | 0.232207 | 0.069229 | 38 | 10 | 1 | 5.641 |
| YxxxF | HhhcC | 33.4 | 10 | 178.8 | 7.634612 | 3.9592e−14 | 0.186801 | 0.055774 | 31 | 41 | 27 | 14.079 |
| GRxxxE | CChhhH | 25.7 | 7.7 | 147.8 | 6.68039 | 4.1501e−11 | 0.173884 | 0.051943 | 31 | 30 | 28 | 5.267 |
| LPxxV | CChhH | 31.7 | 9.5 | 328.1 | 7.31376 | 4.3680e−13 | 0.096617 | 0.028935 | 31 | 31 | 18 | 5.61 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| ExxxxV | EcceeE | 46.8 | 14 | 318.4 | 8.939876 | 6.6359e-19 | 0.146985 | 0.044109 | 54 | 55 | 39 | 6.26 |
| AxxxGA | HhhhCC | 26.9 | 8.1 | 515.8 | 6.675596 | 4.0624e-11 | 0.052152 | 0.015659 | 32 | 38 | 29 | 11.774 |
| RxxL | HhhE | 32.4 | 9.7 | 158.9 | 7.491324 | 1.1856e-13 | 0.203902 | 0.061321 | 35 | 36 | 19 | 3.333 |
| AxxGxP | HhcCcC | 32.9 | 9.9 | 247.6 | 7.451189 | 1.5600e-13 | 0.132876 | 0.040039 | 40 | 44 | 34 | 7.278 |
| FxxxxK | CchhhH | 35.7 | 10.8 | 264.1 | 7.751308 | 1.5295e-14 | 0.135176 | 0.040809 | 41 | 45 | 36 | 8.614 |
| QTP | HCH | 22.1 | 6.7 | 47.9 | 6.42922 | 2.4745e-10 | 0.461378 | 0.139514 | 22 | 16 | 1 | 7.831 |
| KxxGF | HhcCC | 37.3 | 11.3 | 204.8 | 7.969461 | 2.7196e-15 | 0.182129 | 0.055082 | 44 | 44 | 34 | 8.977 |
| NTxVD | CEeEE | 32.3 | 9.8 | 136.8 | 7.475662 | 1.3386e-13 | 0.236111 | 0.071465 | 38 | 10 | 1 | 5.641 |
| SSxxVD | HCeeEE | 40.7 | 12.3 | 215.6 | 8.311402 | 1.6093e-16 | 0.188776 | 0.057261 | 53 | 14 | 1 | 5.5 |
| GxSxxQ | CcChhH | 32.5 | 9.9 | 203.2 | 7.392465 | 2.4290e-13 | 0.159941 | 0.048517 | 38 | 46 | 32 | 3.241 |
| MxxxxL | HhhccC | 37.8 | 11.5 | 525 | 7.853004 | 6.6035e-15 | 0.072 | 0.021871 | 46 | 52 | 41 | 8.19 |
| NxLP | HhCC | 31.4 | 9.5 | 153.2 | 7.304107 | 4.7698e-13 | 0.204961 | 0.062314 | 35 | 40 | 29 | 7.155 |
| DxxSN | HhhHH | 31 | 9.4 | 133.5 | 7.288476 | 5.4139e-13 | 0.23221 | 0.070612 | 29 | 34 | 21 | 3.4 |
| DRC | CCC | 32.2 | 9.8 | 127.8 | 7.444459 | 1.6904e-13 | 0.250194 | 0.076146 | 35 | 28 | 13 | 11.164 |
| ExxxxK | EcceeE | 43.1 | 13.1 | 168.8 | 8.606301 | 1.3067e-17 | 0.255332 | 0.077849 | 46 | 60 | 39 | 3.758 |
| RxxFV | HhhHH | 24.5 | 7.5 | 193.4 | 6.343231 | 3.7108e-10 | 0.12668 | 0.038702 | 26 | 20 | 5 | 3.886 |
| HxxxxR | CchhhH | 42.2 | 12.9 | 198.2 | 8.441254 | 5.3279e-17 | 0.212916 | 0.065049 | 44 | 48 | 33 | 16.485 |
| SxxDS | HhhHH | 28.9 | 8.9 | 121.4 | 6.997453 | 4.4603e-12 | 0.238056 | 0.072925 | 31 | 35 | 29 | 6.813 |
| SxW | ChH | 89.6 | 27.5 | 434.3 | 12.254 | 2.6846e-34 | 0.206309 | 0.063216 | 84 | 91 | 42 | 39.624 |
| TxSxxE | CcChhH | 26.4 | 8.1 | 188.8 | 6.57813 | 7.8469e-11 | 0.139831 | 0.042863 | 31 | 34 | 29 | 3.467 |
| ExxLP | HhhCC | 31.6 | 9.7 | 176.5 | 7.229156 | 8.0852e-13 | 0.179037 | 0.054991 | 30 | 32 | 26 | 7.579 |
| ExxxxT | EecceE | 36.9 | 11.3 | 146.3 | 7.899199 | 4.7926e-15 | 0.252221 | 0.07755 | 41 | 43 | 32 | 7.786 |
| TQA | CHH | 28.7 | 8.8 | 79.5 | 7.084686 | 2.4870e-12 | 0.361006 | 0.111203 | 29 | 33 | 24 | 7.459 |
| YxxxxQ | EccccC | 41.7 | 12.9 | 277.2 | 8.238435 | 2.8485e-16 | 0.150433 | 0.046375 | 43 | 47 | 27 | 9.222 |
| RIxxN | HHHhH | 31.3 | 9.7 | 211.7 | 7.132289 | 1.6125e-12 | 0.147851 | 0.045594 | 32 | 23 | 15 | 10.306 |
| DxSQ | EcCC | 24.6 | 7.6 | 83.1 | 6.463222 | 1.7704e-10 | 0.296029 | 0.091555 | 23 | 25 | 12 | 3.077 |
| RxxGI | HhcCC | 41 | 12.7 | 265.2 | 8.142027 | 6.3123e-16 | 0.1546 | 0.047865 | 52 | 60 | 49 | 6.078 |
| KxxGxN | HhcCcC | 33.4 | 10.3 | 186.4 | 7.375182 | 2.6922e-13 | 0.179185 | 0.055503 | 38 | 41 | 22 | 3.053 |
| ExxAA | HhhHC | 52.1 | 16.1 | 214 | 9.306055 | 2.2237e-20 | 0.243458 | 0.075445 | 64 | 66 | 52 | 8.575 |
| SxxxxY | HhheccC | 32.3 | 10 | 223.4 | 7.202322 | 9.5601e-13 | 0.144584 | 0.044849 | 33 | 37 | 30 | 10.279 |
| WxxP | CchH | 45.8 | 14.2 | 136.8 | 8.84778 | 1.5505e-18 | 0.334795 | 0.103937 | 44 | 60 | 23 | 12.363 |
| ExxxAL | HhhhHC | 32.2 | 10 | 257.3 | 7.160501 | 1.2869e-12 | 0.125146 | 0.038867 | 37 | 36 | 30 | 1.667 |
| RxxxD | CechH | 23.6 | 7.4 | 54.6 | 6.44067 | 2.1538e-10 | 0.432234 | 0.134677 | 22 | 29 | 8 | 2.167 |
| AxxxGL | HhhhCC | 28.1 | 8.8 | 473.3 | 6.596022 | 6.5719e-11 | 0.05937 | 0.018507 | 34 | 33 | 33 | 6.75 |
| WxG | CcH | 47.8 | 14.9 | 153.6 | 8.967722 | 5.1676e-19 | 0.311198 | 0.097025 | 43 | 51 | 23 | 13.556 |
| ExSxxE | CcChhH | 46.7 | 14.6 | 297.5 | 8.631726 | 9.6940e-18 | 0.156975 | 0.048973 | 50 | 50 | 40 | 11.231 |
| RxxI | HhhE | 27 | 8.4 | 142.7 | 6.580268 | 7.6218e-11 | 0.189208 | 0.059204 | 28 | 28 | 18 | 4.75 |
| KxF | CeC | 35.5 | 11.1 | 146.1 | 7.608196 | 4.5904e-14 | 0.242984 | 0.076091 | 40 | 51 | 16 | 6.317 |
| TxAxxR | ChHhhH | 26 | 8.1 | 180.3 | 6.402991 | 7.4282e-11 | 0.145333 | 0.045534 | 26 | 30 | 25 | 5.688 |
| AxGxR | HcCcC | 36.6 | 11.5 | 170.4 | 7.680274 | 2.5874e-14 | 0.214789 | 0.06734 | 42 | 47 | 39 | 10.232 |
| RxxGxN | HhcCcC | 27.5 | 8.6 | 166 | 6.600575 | 6.5622e-11 | 0.165663 | 0.051959 | 32 | 37 | 18 | 2 |
| LxxxxI | CchhhH | 120.9 | 37.9 | 1893.1 | 13.6104 | 5.3167e-42 | 0.063864 | 0.020034 | 139 | 130 | 97 | 17.117 |
| EDxxR | HHHhH | 34.2 | 10.8 | 168.1 | 7.391077 | 2.3540e-13 | 0.20345 | 0.063963 | 35 | 37 | 20 | 1.694 |
| NxxSL | HhhHH | 28.2 | 8.9 | 193.6 | 6.646094 | 4.7656e-11 | 0.145661 | 0.045803 | 30 | 31 | 23 | 5.507 |
| LNxxQ | CChhH | 24.6 | 7.7 | 175.6 | 6.199337 | 8.9664e-10 | 0.140091 | 0.04407 | 27 | 29 | 23 | 9.015 |
| KxDKK | EeEEE | 72.2 | 22.8 | 341.6 | 10.7017 | 1.5998e-26 | 0.211358 | 0.066796 | 81 | 22 | 1 | 5.808 |
| KxxGA | HhccC | 44 | 13.9 | 283.3 | 8.262977 | 2.2260e-16 | 0.155312 | 0.049167 | 55 | 68 | 45 | 5.091 |
| TxAxxE | ChHhhH | 42.1 | 13.3 | 254.5 | 8.093575 | 9.1094e-16 | 0.165422 | 0.052386 | 46 | 44 | 34 | 5.667 |
| VxxxxQ | CchhhH | 41.1 | 13 | 292.8 | 7.955165 | 2.7819e-15 | 0.140369 | 0.044502 | 47 | 59 | 39 | 8.622 |
| DSV | EEE | 27 | 8.6 | 127.2 | 6.521739 | 1.1133e-10 | 0.212264 | 0.067344 | 32 | 31 | 8 | 3.083 |
| GxxxxQ | CcchhH | 255.1 | 81.2 | 1223.1 | 19.98054 | 1.2830e-88 | 0.208568 | 0.066361 | 268 | 302 | 205 | 46.327 |
| SxxxxV | HhhhcC | 35.4 | 11.3 | 332.5 | 7.310744 | 4.0564e-13 | 0.106466 | 0.033905 | 46 | 47 | 40 | 7.398 |
| NxxRN | HhhHH | 33.2 | 10.6 | 140.1 | 7.23656 | 7.3844e-13 | 0.236974 | 0.075474 | 37 | 38 | 27 | 5.133 |
| YxxxN | HhhhH | 359.7 | 114.6 | 1469.5 | 23.8353 | 2.2944e-125 | 0.244777 | 0.078017 | 311 | 417 | 220 | 77.817 |
| SAxxxR | CHhhhH | 38.1 | 12.2 | 224.6 | 7.644138 | 3.2710e-14 | 0.169635 | 0.054175 | 38 | 37 | 21 | 5.834 |
| EGxT | ECcE | 26.5 | 8.5 | 78 | 6.552315 | 9.4222e-11 | 0.339744 | 0.10876 | 28 | 30 | 15 | 1.51 |
| LxxxxY | CchhhH | 42 | 13.5 | 555.3 | 7.880036 | 4.8923e-15 | 0.075635 | 0.024224 | 52 | 50 | 41 | 8.542 |
| TxxxxW | CchhhH | 26.8 | 8.6 | 193.7 | 6.357807 | 3.1394e-10 | 0.138358 | 0.044331 | 32 | 27 | 13 | 9.251 |
| ExxxxP | EecceE | 34.5 | 11.1 | 144.7 | 7.333049 | 3.5729e-13 | 0.238424 | 0.076446 | 38 | 41 | 32 | 2.484 |
| AxxxxR | CchhhH | 115.3 | 37 | 706.6 | 13.22827 | 9.2344e-40 | 0.163176 | 0.052343 | 125 | 142 | 105 | 26.714 |
| LGF | HCC | 32.9 | 10.6 | 200.8 | 7.063506 | 2.5027e-12 | 0.163845 | 0.052585 | 37 | 40 | 32 | 5.018 |
| ITxxQ | CChhH | 28.7 | 9.2 | 189 | 6.582122 | 7.1234e-11 | 0.151852 | 0.04875 | 34 | 34 | 28 | 11.232 |
| TxxxxR | CchhhH | 97.2 | 31.2 | 509.4 | 12.1895 | 5.4680e-34 | 0.190813 | 0.061279 | 107 | 125 | 93 | 23.513 |
| STKV | CEEE | 69.5 | 22.3 | 234.9 | 10.49468 | 1.4747e-25 | 0.295871 | 0.095048 | 75 | 24 | 1 | 5.036 |
| IxxxxY | CchhhH | 27.2 | 8.7 | 372.9 | 6.318022 | 3.9509e-10 | 0.072942 | 0.02344 | 36 | 36 | 36 | 7.75 |
| SPxxLS | ECceEE | 30 | 9.7 | 170.2 | 6.744862 | 2.3659e-11 | 0.176263 | 0.056698 | 35 | 22 | 2 | 1 |
| ALS | EEE | 27 | 8.7 | 349.5 | 6.287868 | 4.7936e-10 | 0.077253 | 0.024873 | 30 | 29 | 17 | 1.825 |
| FxxxE | EehhH | 30.6 | 9.9 | 170.7 | 6.807095 | 1.5366e-11 | 0.179262 | 0.057738 | 35 | 38 | 21 | 7.082 |
| SxxxxQ | CchhhH | 107.1 | 34.6 | 557.3 | 12.73468 | 5.8204e-37 | 0.192177 | 0.062044 | 123 | 129 | 80 | 29.468 |
| SxxPG | HhcCC | 30 | 9.7 | 107.9 | 6.839335 | 1.2706e-11 | 0.278035 | 0.089798 | 34 | 38 | 14 | 6.743 |
| TVA | CHH | 40.3 | 13 | 137 | 7.949197 | 3.0102e-15 | 0.294161 | 0.095013 | 42 | 40 | 29 | 10.153 |
| KxHG | HhHC | 25.4 | 8.2 | 85.6 | 6.310346 | 4.4829e-10 | 0.296729 | 0.095898 | 29 | 33 | 23 | 6.286 |
| DxPxY | CcCcC | 26.5 | 8.6 | 158 | 6.299163 | 4.5765e-10 | 0.167722 | 0.05423 | 26 | 30 | 15 | 2.875 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| SSTxV | HCEeE | 44.7 | 14.5 | 217.1 | 8.214938 | 3.2657e-16 | 0.205896 | 0.066745 | 56 | 16 | 1 | 5.536 |
| SSxKV | HCeEE | 42.6 | 13.8 | 198 | 8.026654 | 1.5452e-15 | 0.215152 | 0.0698 | 54 | 17 | 1 | 4.536 |
| NTxxxK | CEeeeE | 33.8 | 11 | 168.6 | 7.116682 | 1.6931e-12 | 0.200474 | 0.065182 | 38 | 13 | 4 | 6.141 |
| LPxxQ | CChhH | 26 | 8.5 | 150.9 | 6.209625 | 8.0645e-10 | 0.1723 | 0.056038 | 27 | 29 | 24 | 6.067 |
| SxTxxE | CcChhH | 26.3 | 8.6 | 179.1 | 6.210132 | 7.9457e-10 | 0.146845 | 0.047823 | 35 | 32 | 21 | 6.641 |
| PxSQ | ChHH | 31.3 | 10.2 | 111 | 6.920163 | 7.0916e-12 | 0.281982 | 0.092073 | 33 | 39 | 25 | 6.917 |
| YxxxxR | EccceE | 42 | 13.7 | 199.7 | 7.912163 | 3.8543e-15 | 0.210315 | 0.068697 | 48 | 46 | 8 | 9.456 |
| PxxLT | HhhHH | 34.7 | 11.3 | 229.3 | 7.111345 | 1.7124e-12 | 0.15133 | 0.049482 | 34 | 19 | 6 | 4.5 |
| WxxxxK | CchhH | 33.1 | 10.8 | 143.7 | 7.034008 | 3.0769e-12 | 0.230341 | 0.075405 | 39 | 43 | 23 | 7.556 |
| SxTKV | HcEEE | 63.7 | 20.9 | 316.4 | 9.703558 | 4.3917e-22 | 0.201327 | 0.065941 | 79 | 26 | 1 | 9.869 |
| WxxxE | CchhH | 64.8 | 21.2 | 274 | 9.845227 | 1.0984e-22 | 0.236496 | 0.077482 | 62 | 77 | 54 | 16.611 |
| YxxxH | HhhhC | 112.7 | 36.9 | 440.2 | 13.02159 | 1.4162e-38 | 0.25602 | 0.083929 | 129 | 149 | 109 | 34.612 |
| SAxxxK | CHhhH | 30 | 9.9 | 163.6 | 6.620898 | 5.3547e-11 | 0.183374 | 0.060226 | 32 | 39 | 22 | 6 |
| PVxxA | HHhhH | 42.9 | 14.1 | 430.6 | 7.802016 | 8.8311e-15 | 0.099628 | 0.03273 | 42 | 46 | 28 | 3.2 |
| LxxxxI | HhhccC | 81.5 | 26.8 | 1641 | 10.66137 | 2.1892e-26 | 0.049665 | 0.016319 | 99 | 104 | 90 | 18.507 |
| NxxxDK | CeeeEE | 29.8 | 9.8 | 140.6 | 6.628627 | 5.1332e-11 | 0.211949 | 0.069648 | 34 | 8 | 1 | 5.641 |
| SxLP | HhCC | 41.8 | 13.8 | 235.1 | 7.791006 | 9.8874e-15 | 0.177797 | 0.058524 | 47 | 57 | 38 | 5.326 |
| IxxxxN | CcchhH | 27.4 | 9.1 | 214.6 | 6.232302 | 6.7019e-10 | 0.127679 | 0.042173 | 29 | 30 | 18 | 4.045 |
| KVDxK | EEEeE | 71.7 | 23.7 | 345.2 | 10.22337 | 2.3244e-24 | 0.207706 | 0.068609 | 81 | 22 | 1 | 5.808 |
| NxV | HhE | 37.2 | 12.3 | 189.2 | 7.349348 | 2.9702e-13 | 0.196617 | 0.064947 | 37 | 44 | 26 | 9.9 |
| AxGF | HcCC | 33.5 | 11.1 | 222.8 | 6.917099 | 6.7617e-12 | 0.150359 | 0.049674 | 39 | 40 | 32 | 6.281 |
| VxxxxV | EcceeE | 36.6 | 12.1 | 520 | 7.116802 | 1.5683e-12 | 0.070385 | 0.023302 | 36 | 40 | 28 | 10.501 |
| DxAxxD | ChHhhH | 28.7 | 9.5 | 168.1 | 6.409489 | 2.1528e-10 | 0.170732 | 0.056547 | 34 | 38 | 32 | 4.5 |
| DxDGxG | CcCCcC | 35.9 | 11.9 | 416.7 | 7.054973 | 2.4585e-12 | 0.086153 | 0.028573 | 36 | 39 | 13 | 4.333 |
| TxxxxT | EecceE | 82.4 | 27.3 | 361.9 | 10.95296 | 9.5962e-28 | 0.227687 | 0.075539 | 88 | 97 | 64 | 17.615 |
| QxxxxQ | CchhhH | 45.1 | 15 | 238.9 | 8.045709 | 1.2643e-15 | 0.188782 | 0.062644 | 46 | 53 | 35 | 8.666 |
| DGR | HCC | 24.9 | 8.3 | 59.6 | 6.223041 | 7.9087e-10 | 0.417785 | 0.138959 | 28 | 31 | 21 | 4.046 |
| RxxxxH | HhhccC | 65.2 | 21.7 | 297.8 | 9.703437 | 4.3224e-22 | 0.218939 | 0.072826 | 71 | 77 | 61 | 18.915 |
| TDV | CCH | 28.4 | 9.5 | 124.7 | 6.397493 | 2.3547e-10 | 0.227747 | 0.075963 | 31 | 33 | 12 | 5.485 |
| ExxGA | HhhCC | 41.1 | 13.7 | 243.7 | 7.613209 | 3.8832e-14 | 0.16865 | 0.056268 | 48 | 61 | 43 | 5.717 |
| GST | CEE | 28 | 9.3 | 96.7 | 6.422618 | 2.0456e-10 | 0.289555 | 0.096607 | 28 | 25 | 8 | 4.048 |
| SxxxxR | CchhhH | 124.8 | 41.7 | 647.7 | 13.30661 | 3.0825e-40 | 0.192682 | 0.064369 | 133 | 159 | 109 | 32.489 |
| QSxxS | EEccE | 30.2 | 10.1 | 204.5 | 6.487393 | 1.2578e-10 | 0.147677 | 0.049385 | 37 | 20 | 3 | 3 |
| AxxQG | HhhhHH | 30.2 | 10.1 | 218 | 6.47422 | 1.3671e-10 | 0.138532 | 0.046347 | 31 | 36 | 15 | 1.13 |
| YxGS | EcCC | 36.1 | 12.1 | 183.1 | 7.135684 | 1.4043e-12 | 0.19716 | 0.06612 | 43 | 46 | 24 | 11.26 |
| AxxGL | HhhCC | 41.1 | 13.8 | 280.1 | 7.540236 | 6.6990e-14 | 0.146733 | 0.049246 | 46 | 50 | 40 | 9.057 |
| QxxxW | HhhhH | 165.8 | 55.6 | 973.5 | 15.20679 | 4.5631e-52 | 0.170313 | 0.057164 | 158 | 184 | 121 | 37.643 |
| HxxxxS | HhhhcC | 31.5 | 10.6 | 219.9 | 6.594011 | 6.1157e-11 | 0.143247 | 0.048099 | 34 | 40 | 30 | 7.333 |
| TxAxxQ | ChHhhH | 35.1 | 11.8 | 204.9 | 6.994651 | 3.8335e-12 | 0.171303 | 0.057525 | 42 | 42 | 19 | 4.784 |
| TAxxxE | CHHhhH | 29.1 | 9.8 | 179.3 | 6.350328 | 3.0867e-10 | 0.162298 | 0.054574 | 37 | 31 | 25 | 1.668 |
| MxxxxR | CchhhH | 51.3 | 17.3 | 353 | 8.401305 | 6.2683e-17 | 0.145326 | 0.048896 | 65 | 72 | 61 | 7.795 |
| TxAQ | ChHH | 65.5 | 22 | 303.2 | 9.611531 | 1.0400e-21 | 0.216029 | 0.072705 | 74 | 76 | 61 | 10.824 |
| ANxP | HHcC | 30.6 | 10.3 | 110 | 6.640679 | 4.6760e-11 | 0.278182 | 0.093685 | 28 | 34 | 24 | 2.667 |
| YxxxM | CchhH | 28.1 | 9.5 | 219.6 | 6.178173 | 9.1504e-10 | 0.12796 | 0.043199 | 30 | 35 | 21 | 11.567 |
| GxxxxY | CcchhH | 68.3 | 23.1 | 533.9 | 9.630341 | 8.3399e-22 | 0.127927 | 0.043196 | 66 | 80 | 46 | 32.127 |
| NxxVxK | CeeEeE | 31.3 | 10.6 | 203.1 | 6.545306 | 8.4370e-11 | 0.154111 | 0.052072 | 36 | 10 | 2 | 5.641 |
| Dxx | HHhhH | 34.4 | 11.6 | 212.9 | 6.864841 | 9.4633e-12 | 0.161578 | 0.054645 | 43 | 43 | 33 | 1.163 |
| NxxxN | HhchH | 28.5 | 9.7 | 69.5 | 6.537397 | 9.8303e-11 | 0.410072 | 0.138884 | 28 | 24 | 6 | 6.331 |
| RxNG | EeCC | 51.7 | 17.5 | 171.1 | 8.620737 | 9.9272e-18 | 0.302162 | 0.102376 | 46 | 56 | 34 | 12.172 |
| TxxDxK | EeeEeE | 71.3 | 24.2 | 396.7 | 9.891898 | 6.4050e-23 | 0.179733 | 0.060932 | 81 | 18 | 2 | 6.808 |
| ARxP | HHcC | 39.6 | 13.4 | 140.5 | 7.511607 | 8.6527e-14 | 0.281851 | 0.095553 | 42 | 50 | 39 | 3.827 |
| SxAxxA | ChHhhH | 31.9 | 10.8 | 324.7 | 6.517178 | 9.9192e-11 | 0.098245 | 0.033327 | 43 | 44 | 40 | 8.897 |
| LxxTG | HhhHC | 31.7 | 10.8 | 282.8 | 6.51068 | 1.0405e-10 | 0.112093 | 0.038036 | 35 | 37 | 21 | 11.255 |
| QCG | CCC | 28.6 | 9.7 | 138.1 | 6.276235 | 4.9829e-10 | 0.207096 | 0.070437 | 30 | 33 | 17 | 12.384 |
| RSxxE | CChhH | 37 | 12.6 | 179.8 | 7.134674 | 1.3888e-12 | 0.205784 | 0.070013 | 40 | 44 | 39 | 8.156 |
| WxxxN | HhhhC | 95 | 32.4 | 413 | 11.46138 | 2.9542e-30 | 0.230024 | 0.078414 | 111 | 120 | 80 | 19.341 |
| FxxxR | HhhhC | 77.3 | 26.4 | 401.6 | 10.25513 | 1.5834e-24 | 0.19248 | 0.065697 | 84 | 99 | 66 | 13.27 |
| KVxKK | EEeEE | 71.2 | 24.3 | 349.6 | 9.858861 | 8.8905e-23 | 0.203661 | 0.069538 | 81 | 22 | 1 | 5.808 |
| NxAQ | ChHH | 32.7 | 11.2 | 137.8 | 6.713106 | 2.7429e-11 | 0.2373 | 0.081146 | 31 | 35 | 24 | 15.55 |
| YxxxxE | CcchhH | 85.7 | 29.3 | 538.1 | 10.71176 | 1.2450e-26 | 0.159264 | 0.054469 | 95 | 106 | 83 | 21.141 |
| DxxxxV | EccccE | 29.2 | 10 | 277.5 | 6.186242 | 8.4465e-10 | 0.105225 | 0.036023 | 30 | 33 | 29 | 5.592 |
| DxxxxW | CcccCE | 33.5 | 11.5 | 263 | 6.65024 | 4.0350e-11 | 0.127376 | 0.04362 | 42 | 41 | 36 | 8.248 |
| DSxE | CChH | 66 | 22.6 | 239.7 | 9.582583 | 1.3711e-21 | 0.275344 | 0.094387 | 64 | 81 | 50 | 13.344 |
| GxNxxE | CcChhH | 35.9 | 12.3 | 268.7 | 6.879201 | 8.2900e-12 | 0.133606 | 0.045839 | 38 | 44 | 32 | 11.001 |
| SQxxT | HHhhH | 29.8 | 10.2 | 148.5 | 6.344138 | 3.1629e-10 | 0.200673 | 0.068853 | 30 | 38 | 22 | 5.454 |
| RxxxxI | HhhccC | 47.6 | 16.3 | 347.7 | 7.919529 | 3.2760e-15 | 0.1369 | 0.047007 | 56 | 60 | 52 | 10.429 |
| IPG | ECC | 28.7 | 9.9 | 160 | 6.179461 | 8.9798e-10 | 0.179375 | 0.061769 | 33 | 34 | 23 | 10.241 |
| DxxxxT | EcceeE | 70.6 | 24.4 | 581 | 9.569481 | 1.4539e-21 | 0.121515 | 0.041937 | 79 | 88 | 58 | 9.906 |
| YxxxxQ | HhhhcC | 40.4 | 14 | 300.9 | 7.244583 | 5.9055e-13 | 0.134264 | 0.046407 | 52 | 56 | 48 | 10.814 |
| ExSG | HhHC | 34 | 11.8 | 154.5 | 6.751139 | 2.0640e-11 | 0.220065 | 0.076071 | 35 | 44 | 32 | 6.005 |
| SSTK | HCEE | 54.6 | 18.9 | 198.1 | 8.640682 | 7.9973e-18 | 0.275618 | 0.09533 | 65 | 27 | 1 | 5.536 |
| RxxxxY | CcchhH | 31.1 | 10.8 | 222.8 | 6.349861 | 2.9387e-10 | 0.139587 | 0.048342 | 40 | 43 | 32 | 1.884 |
| WxxxQ | HhhhH | 201.9 | 69.9 | 1001.1 | 16.36292 | 4.8607e-60 | 0.201678 | 0.069854 | 204 | 248 | 166 | 40.546 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| DxAxxR | ChHhhH | 33.9 | 11.7 | 212.5 | 6.651301 | 3.9842e−11 | 0.159529 | 0.055269 | 39 | 46 | 35 | 7 |
| YQxxL | HHHhH | 40.1 | 13.9 | 386.6 | 7.155977 | 1.1141e−12 | 0.103725 | 0.035961 | 45 | 45 | 40 | 8.875 |
| YxxxxR | EecccC | 35.9 | 12.5 | 301.6 | 6.782838 | 1.5881e−11 | 0.119032 | 0.041308 | 39 | 45 | 28 | 4.289 |
| RxxGxP | HhhCcC | 35 | 12.1 | 274.9 | 6.707417 | 2.6783e−11 | 0.127319 | 0.044184 | 47 | 44 | 39 | 11.283 |
| VSxxE | CChhH | 56.4 | 19.6 | 340.2 | 8.573591 | 1.3696e−17 | 0.165785 | 0.057539 | 61 | 73 | 52 | 5.783 |
| SxxKxD | HceEeE | 57 | 19.8 | 313.1 | 8.642784 | 7.5321e−18 | 0.18205 | 0.063201 | 72 | 20 | 1 | 9.833 |
| RxxGA | HhcCC | 31.8 | 11 | 222.8 | 6.40728 | 2.0139e−10 | 0.142729 | 0.049563 | 38 | 42 | 35 | 6.731 |
| NxKxD | CeEeE | 36.1 | 12.5 | 155.1 | 6.939188 | 5.5327e−12 | 0.232753 | 0.080856 | 43 | 14 | 2 | 6.641 |
| PTE | CCH | 41.7 | 14.5 | 177.9 | 7.44701 | 1.3352e−13 | 0.234401 | 0.081576 | 44 | 40 | 20 | 7.061 |
| TLP | HCC | 29.6 | 10.3 | 120.5 | 6.286176 | 4.5831e−10 | 0.245643 | 0.085508 | 34 | 39 | 27 | 9 |
| DxxGxG | CccCcC | 95.4 | 33.3 | 1003.2 | 10.95388 | 8.3945e−28 | 0.095096 | 0.033166 | 90 | 100 | 43 | 17.791 |
| RxGL | HhCC | 42.9 | 15 | 220.2 | 7.477473 | 1.0395e−13 | 0.194823 | 0.067983 | 49 | 51 | 45 | 5.1 |
| KxxGxN | HhhCcC | 32.1 | 11.2 | 196.9 | 6.425281 | 1.7880e−10 | 0.163027 | 0.056929 | 39 | 43 | 25 | 4.915 |
| QxxND | HhhHH | 36.3 | 12.7 | 151.8 | 6.922566 | 6.1794e−12 | 0.23913 | 0.083607 | 38 | 44 | 30 | 3.862 |
| TPN | CHH | 40.3 | 14.1 | 123 | 7.419598 | 1.6934e−13 | 0.327642 | 0.114566 | 39 | 37 | 12 | 19.754 |
| PxxxxH | CcchhH | 41.9 | 14.7 | 291.5 | 7.302953 | 3.7793e−13 | 0.143739 | 0.050274 | 48 | 49 | 40 | 12.086 |
| NxxRR | HhhHH | 32.6 | 11.4 | 160.5 | 6.512143 | 1.0185e−10 | 0.203115 | 0.071054 | 35 | 40 | 32 | 12.332 |
| DVQ | CHH | 29.6 | 10.4 | 118.8 | 6.257869 | 5.4630e−10 | 0.249168 | 0.087188 | 33 | 38 | 20 | 6.179 |
| ExxGxP | HhcCcC | 32.8 | 11.5 | 226.1 | 6.450292 | 1.4987e−10 | 0.145069 | 0.050838 | 39 | 40 | 36 | 2.2 |
| QAxG | HHcC | 58.1 | 20.4 | 220.9 | 8.766703 | 2.5643e−18 | 0.263015 | 0.092292 | 61 | 73 | 51 | 12.929 |
| PExxN | HHHhH | 42.6 | 15 | 197.4 | 7.430722 | 1.4792e−13 | 0.215805 | 0.075812 | 45 | 51 | 39 | 6.752 |
| TxxSR | HhhHH | 30.7 | 10.8 | 166.3 | 6.270388 | 4.8902e−10 | 0.184606 | 0.064858 | 32 | 34 | 26 | 6.98 |
| NxxxV | HhhcC | 46.4 | 16.3 | 193.8 | 7.784519 | 9.6539e−15 | 0.239422 | 0.084169 | 52 | 56 | 46 | 6.751 |
| SxxVS | HhhHH | 38.1 | 13.4 | 307.2 | 6.902395 | 6.7722e−12 | 0.124023 | 0.043603 | 43 | 44 | 32 | 4.586 |
| IxxxxQ | CchhH | 31.2 | 11 | 289.5 | 6.22516 | 6.3449e−10 | 0.107772 | 0.037904 | 33 | 37 | 29 | 4.5 |
| WxxxR | HhhhC | 44.2 | 15.5 | 225.7 | 7.531965 | 6.7825e−14 | 0.197321 | 0.069416 | 55 | 55 | 38 | 5.651 |
| TxVxK | EeEeE | 106.2 | 37.4 | 568.5 | 11.64047 | 3.4471e−31 | 0.186807 | 0.065781 | 120 | 42 | 7 | 11.641 |
| GDxT | CCcE | 34.9 | 12.3 | 154.9 | 6.715037 | 2.5763e−11 | 0.225307 | 0.079419 | 35 | 31 | 19 | 11.5 |
| SAxG | HHhC | 37.8 | 13.3 | 158.5 | 7.005915 | 3.3764e−12 | 0.238486 | 0.084068 | 42 | 42 | 30 | 6.643 |
| MxxxxK | CchhH | 41.1 | 14.5 | 281.9 | 7.178243 | 9.3821e−13 | 0.145696 | 0.051396 | 46 | 53 | 43 | 11.993 |
| PAxxS | HHhhH | 35.4 | 12.5 | 225.7 | 6.664198 | 3.5462e−11 | 0.156845 | 0.055384 | 41 | 45 | 31 | 3.833 |
| SxAxxE | ChHhhH | 40.7 | 14.4 | 301.5 | 7.112073 | 1.5082e−12 | 0.134992 | 0.047697 | 47 | 50 | 44 | 4.828 |
| AxxAS | HhhHC | 33 | 11.7 | 230 | 6.390864 | 2.1762e−10 | 0.143478 | 0.050877 | 40 | 43 | 31 | 3.792 |
| QxxSR | HhhHH | 37.1 | 13.2 | 179.3 | 6.839369 | 1.0685e−11 | 0.206916 | 0.073569 | 34 | 35 | 29 | 6.433 |
| KPxY | CCcC | 42.7 | 15.2 | 188.2 | 7.350314 | 2.6651e−13 | 0.226886 | 0.080837 | 37 | 50 | 23 | 4.761 |
| QxxN | HchH | 38.1 | 13.6 | 85 | 7.25218 | 6.0503e−13 | 0.448235 | 0.159919 | 35 | 34 | 7 | 10.112 |
| YxxxxR | HhhccC | 40.1 | 14.3 | 271.5 | 6.994423 | 3.4742e−12 | 0.147698 | 0.052783 | 45 | 53 | 41 | 9.85 |
| DxxxNG | CcccCC | 41.8 | 14.9 | 391.2 | 7.084546 | 1.7924e−12 | 0.106851 | 0.038196 | 40 | 42 | 19 | 10.25 |
| GxTxxD | CcChhH | 47.3 | 16.9 | 364.4 | 7.557245 | 5.3153e−14 | 0.129904 | 0.046209 | 55 | 63 | 38 | 13.246 |
| RxxxxY | HhhccC | 47.4 | 17 | 288.6 | 7.611015 | 3.5521e−14 | 0.164241 | 0.058825 | 55 | 57 | 40 | 15.183 |
| FxxxxA | CcchhH | 40.1 | 14.4 | 430 | 6.904445 | 6.4267e−12 | 0.093256 | 0.033416 | 48 | 45 | 35 | 5.002 |
| NxxNA | HhhHH | 36.5 | 13.1 | 245.9 | 6.651858 | 3.7623e−11 | 0.148434 | 0.053217 | 33 | 37 | 22 | 4.333 |
| RxxGV | EccCC | 36.3 | 13 | 227.8 | 6.632045 | 4.3072e−11 | 0.15935 | 0.057259 | 41 | 43 | 9 | 2.271 |
| GxxxxY | CchhH | 50.8 | 18.3 | 530.6 | 7.746419 | 1.1980e−14 | 0.095741 | 0.034427 | 57 | 64 | 39 | 23.548 |
| KxxGxP | HhhCcC | 39.7 | 14.3 | 276 | 6.907485 | 6.3677e−12 | 0.143841 | 0.051742 | 48 | 51 | 38 | 7.563 |
| DxxFA | HhhHH | 32.1 | 11.6 | 269 | 6.179608 | 8.2368e−10 | 0.119331 | 0.042945 | 33 | 37 | 33 | 4.083 |
| IxxxxQ | CcchhH | 42 | 15.1 | 342 | 7.070283 | 1.9778e−12 | 0.122807 | 0.044214 | 39 | 45 | 26 | 4.92 |
| PGxxE | CChhH | 48.5 | 17.5 | 230.5 | 7.72459 | 1.4791e−14 | 0.210412 | 0.07577 | 48 | 56 | 43 | 11.467 |
| KVDK | EEEE | 99.7 | 35.9 | 374.1 | 11.1934 | 5.8880e−29 | 0.266506 | 0.096012 | 109 | 34 | 1 | 10.641 |
| TxxxxY | CcchhH | 36.8 | 13.3 | 315.3 | 6.590914 | 5.5645e−11 | 0.116714 | 0.042141 | 47 | 47 | 37 | 7.79 |
| KxxxxY | CcchhH | 48.4 | 17.5 | 296.3 | 7.622571 | 3.2081e−14 | 0.163348 | 0.059004 | 51 | 54 | 40 | 23.023 |
| DxP | EhH | 32.2 | 11.6 | 75.8 | 6.55045 | 8.2319e−11 | 0.424802 | 0.153554 | 35 | 30 | 13 | 3.667 |
| DxxE | EhhH | 85.6 | 30.9 | 287.7 | 10.39894 | 3.3866e−25 | 0.297532 | 0.107574 | 93 | 100 | 54 | 25.308 |
| AAxxG | HHhhC | 61.5 | 22.3 | 619.8 | 8.471116 | 3.0525e−17 | 0.099226 | 0.035912 | 73 | 79 | 69 | 15.583 |
| SFT | EEE | 35.9 | 13 | 322.2 | 6.484796 | 1.1250e−10 | 0.111421 | 0.04034 | 43 | 44 | 40 | 4.286 |
| PExxT | HHhhH | 42.2 | 15.3 | 228.7 | 7.116551 | 1.4320e−12 | 0.184521 | 0.066926 | 48 | 42 | 28 | 6.5 |
| SxTxxD | HcEeeE | 58.2 | 21.1 | 334.4 | 8.334126 | 1.0029e−16 | 0.174043 | 0.063172 | 74 | 20 | 1 | 10.833 |
| YxxxQ | HhhhC | 102 | 37.1 | 412.9 | 11.16651 | 7.8027e−29 | 0.247033 | 0.089869 | 111 | 130 | 98 | 26.582 |
| KxxGxD | HhcCcC | 46.7 | 17 | 284.7 | 7.415308 | 1.5458e−13 | 0.164032 | 0.059814 | 58 | 56 | 37 | 7.429 |
| GLxP | CCcH | 48.9 | 17.8 | 319.3 | 7.570949 | 4.6990e−14 | 0.153148 | 0.055852 | 54 | 59 | 47 | 11.95 |
| GxxxxQ | CchhH | 65.4 | 23.9 | 462.5 | 8.714553 | 3.6676e−18 | 0.141405 | 0.05169 | 66 | 77 | 57 | 10.766 |
| STA | CHH | 36.2 | 13.2 | 133.8 | 6.648716 | 3.9121e−11 | 0.270553 | 0.098935 | 39 | 40 | 33 | 3.125 |
| TKVD | EEEE | 98.5 | 36 | 385.6 | 10.93326 | 1.0444e−27 | 0.255446 | 0.093416 | 111 | 34 | 2 | 11.641 |
| IxxxQ | CchhH | 160.1 | 58.7 | 884.1 | 13.74543 | 6.8834e−43 | 0.181427 | 0.06636 | 158 | 176 | 113 | 39.776 |
| VxxxxE | EcchhH | 59.9 | 21.9 | 499.1 | 8.298175 | 1.3176e−16 | 0.120016 | 0.04391 | 66 | 80 | 34 | 11.21 |
| KSR | CCH | 35.5 | 13 | 108.5 | 6.655961 | 3.8052e−11 | 0.327189 | 0.119737 | 38 | 31 | 11 | 7.78 |
| YxxxT | HhhhC | 53.2 | 19.5 | 299.7 | 7.889466 | 3.8511e−15 | 0.177511 | 0.06509 | 57 | 61 | 45 | 12.654 |
| DRxG | HHhC | 37.3 | 13.7 | 145.5 | 6.710008 | 2.5502e−11 | 0.256357 | 0.094011 | 42 | 48 | 40 | 5.333 |
| HxxxP | HhhccC | 39.5 | 14.5 | 244.4 | 6.775202 | 1.5709e−11 | 0.16162 | 0.059279 | 39 | 40 | 31 | 10.047 |
| MxxxxE | HhhccC | 34.2 | 12.5 | 291.7 | 6.249721 | 5.1266e−10 | 0.117244 | 0.043007 | 42 | 44 | 34 | 6.241 |
| CxxxN | HhhhC | 35 | 12.8 | 213.2 | 6.379588 | 2.2496e−10 | 0.164165 | 0.060223 | 37 | 37 | 21 | 10.833 |
| ERxG | HHcC | 76.1 | 28 | 265.7 | 9.603856 | 1.0100e−21 | 0.286413 | 0.105454 | 79 | 91 | 68 | 16.416 |
| LxxxE | EehhH | 67.4 | 24.8 | 495.9 | 8.759329 | 2.4343e−18 | 0.135914 | 0.050103 | 75 | 77 | 37 | 7.941 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| NSG | ECC | 33.8 | 12.5 | 139.3 | 6.33532 | 3.0683e-10 | 0.242642 | 0.08945 | 41 | 36 | 13 | 7.933 |
| GxTxY | CcEeE | 52.6 | 19.4 | 391 | 7.732901 | 1.3037e-14 | 0.134527 | 0.04961 | 58 | 58 | 25 | 16.729 |
| TxxxxQ | CchhhH | 45.5 | 16.8 | 336.6 | 7.185919 | 8.2803e-13 | 0.135175 | 0.049896 | 53 | 63 | 45 | 9.89 |
| KxxxxY | HhhccC | 67 | 24.7 | 384 | 8.786447 | 1.9357e-18 | 0.174479 | 0.06441 | 78 | 85 | 65 | 16.036 |
| WxxxH | HhhhH | 68.2 | 25.2 | 453.8 | 8.807377 | 1.5890e-18 | 0.150286 | 0.055571 | 76 | 85 | 68 | 19.873 |
| FxxxxE | CcchhH | 87.8 | 32.5 | 685.4 | 9.926259 | 3.9216e-23 | 0.1281 | 0.047474 | 108 | 119 | 97 | 22.741 |
| DxSV | CcCE | 35.2 | 13.1 | 239.4 | 6.298075 | 3.7348e-10 | 0.147034 | 0.054574 | 33 | 39 | 26 | 9.027 |
| GxDxxE | CcChhH | 36.8 | 13.7 | 254.3 | 6.426476 | 1.6131e-10 | 0.144711 | 0.053792 | 41 | 45 | 34 | 3.92 |
| ExxGI | HhCCC | 36.6 | 13.7 | 252.1 | 6.381846 | 2.1498e-10 | 0.14518 | 0.054187 | 44 | 50 | 41 | 4.904 |
| YxxxM | HhhhH | 172.2 | 64.3 | 1625.8 | 13.71903 | 9.3692e-43 | 0.105956 | 0.039595 | 187 | 196 | 139 | 41.857 |
| ExLP | HhCC | 42.2 | 15.8 | 295.8 | 6.839588 | 9.7186e-12 | 0.142664 | 0.053319 | 48 | 51 | 43 | 7 |
| LxxxxV | CchhhH | 90.3 | 33.8 | 1719.7 | 9.813784 | 1.1574e-22 | 0.052509 | 0.019657 | 106 | 108 | 80 | 33.523 |
| YxxxH | HhhhH | 163.9 | 61.4 | 985.3 | 13.51545 | 1.5489e-41 | 0.166345 | 0.062287 | 185 | 210 | 154 | 53.189 |
| STxxR | HhhhH | 44.8 | 16.8 | 265.4 | 7.06881 | 1.9236e-12 | 0.168802 | 0.063213 | 46 | 43 | 30 | 13.239 |
| TxVxxK | EeEeeE | 70.3 | 26.3 | 562.7 | 8.776302 | 2.0407e-18 | 0.124933 | 0.046795 | 81 | 18 | 2 | 6.808 |
| KxSxxE | CcChhH | 34.8 | 13 | 249.7 | 6.189193 | 7.3797e-10 | 0.139367 | 0.052226 | 42 | 44 | 35 | 8.25 |
| QxxxxI | HhhhcC | 36.6 | 13.7 | 262.5 | 6.340297 | 2.7931e-10 | 0.139429 | 0.052303 | 42 | 50 | 28 | 6.99 |
| RSxxL | HhhhH | 42.8 | 16.1 | 361.8 | 6.827799 | 1.0410e-11 | 0.118297 | 0.044377 | 43 | 45 | 33 | 3.5 |
| WxxxN | HhhhH | 162.9 | 61.2 | 825.6 | 13.50641 | 1.7623e-41 | 0.197311 | 0.074149 | 156 | 193 | 123 | 36.661 |
| DxAxxE | ChHhhH | 48.7 | 18.3 | 339.8 | 7.304968 | 3.3650e-13 | 0.14332 | 0.053861 | 55 | 65 | 51 | 9.053 |
| CxxxN | HhhhH | 40.5 | 15.2 | 374.6 | 6.602715 | 4.8363e-11 | 0.108115 | 0.040704 | 40 | 42 | 34 | 8.099 |
| LIS | EEE | 36 | 13.6 | 561.3 | 6.168581 | 8.1408e-10 | 0.064137 | 0.024159 | 42 | 25 | 20 | 6.364 |
| LSxG | HHcC | 39.7 | 15 | 242.9 | 6.598851 | 5.0502e-11 | 0.163442 | 0.061625 | 46 | 50 | 39 | 4.151 |
| LSxxQ | CChhH | 60.8 | 22.9 | 428.9 | 8.130612 | 5.1480e-16 | 0.141758 | 0.053451 | 72 | 77 | 56 | 10.682 |
| YRG | ECC | 44.6 | 16.9 | 163.1 | 7.137134 | 1.2043e-12 | 0.273452 | 0.103338 | 54 | 50 | 22 | 6.727 |
| NTKV | CEEE | 38 | 14.4 | 156.3 | 6.545601 | 7.4133e-11 | 0.243122 | 0.091884 | 43 | 15 | 2 | 6.808 |
| AQxxS | HHhhH | 50.4 | 19 | 360.1 | 7.381135 | 1.8871e-13 | 0.139961 | 0.052899 | 54 | 62 | 43 | 15.095 |
| ISxxE | CChhH | 45.1 | 17.1 | 314.7 | 6.975012 | 3.6776e-12 | 0.143311 | 0.05425 | 52 | 57 | 50 | 6.747 |
| SSxxxD | HCeeeE | 41.2 | 15.6 | 216.6 | 6.724105 | 2.1591e-11 | 0.190212 | 0.072065 | 54 | 15 | 1 | 6.5 |
| RxxGL | HhhCC | 41.8 | 15.9 | 247.8 | 6.726746 | 2.0975e-11 | 0.168684 | 0.064055 | 53 | 59 | 49 | 11.51 |
| HxxxW | HhhhH | 45.1 | 17.1 | 463.5 | 6.884276 | 6.8432e-12 | 0.097303 | 0.036968 | 53 | 60 | 47 | 13.411 |
| KxxxxN | CchhhH | 38.6 | 14.7 | 224.6 | 6.463752 | 1.2361e-10 | 0.171861 | 0.065304 | 42 | 41 | 22 | 10.588 |
| RxxxxQ | CcchhH | 80.6 | 30.6 | 502.4 | 9.316053 | 1.4468e-20 | 0.16043 | 0.060976 | 85 | 89 | 65 | 15.642 |
| IxxxY | CchhH | 38.1 | 14.5 | 319.7 | 6.350739 | 2.5454e-10 | 0.119174 | 0.045305 | 45 | 45 | 34 | 18.265 |
| YxxxL | HhhhC | 91.7 | 34.9 | 677.5 | 9.880421 | 6.0041e-23 | 0.135457 | 0.051474 | 107 | 115 | 93 | 33.564 |
| DAxG | HHhC | 38.6 | 14.7 | 177.7 | 6.514124 | 8.9759e-11 | 0.21722 | 0.082658 | 44 | 52 | 39 | 10.682 |
| NxxxxR | CchhhH | 74.6 | 28.5 | 442.8 | 8.941105 | 4.6087e-19 | 0.168473 | 0.064272 | 80 | 92 | 66 | 13.163 |
| LSA | CCH | 54 | 20.6 | 304.8 | 7.618303 | 3.0894e-14 | 0.177165 | 0.067607 | 58 | 69 | 47 | 8.75 |
| AxxRH | HhhhH | 52.1 | 19.9 | 294.8 | 7.480402 | 8.9042e-14 | 0.17673 | 0.067458 | 52 | 53 | 27 | 9.9 |
| EGxP | HCcC | 36.9 | 14.1 | 148.4 | 6.390062 | 2.0520e-10 | 0.248652 | 0.094911 | 41 | 41 | 17 | 8.331 |
| AFG | HHC | 43 | 16.4 | 221.9 | 6.81187 | 1.1651e-11 | 0.193781 | 0.074044 | 50 | 59 | 42 | 3.041 |
| STK | CEE | 101.6 | 38.9 | 261.2 | 10.9062 | 1.3949e-27 | 0.388974 | 0.148807 | 104 | 57 | 4 | 8.703 |
| ExxxSK | HhhHHH | 43.5 | 16.6 | 292.1 | 6.778914 | 1.4388e-11 | 0.148922 | 0.05698 | 52 | 56 | 39 | 9.048 |
| GxDxxA | CcChhH | 41.7 | 16 | 346.5 | 6.586367 | 5.2939e-11 | 0.120346 | 0.046127 | 46 | 50 | 31 | 10.654 |
| FxxxQ | CchhH | 79.8 | 30.6 | 582.3 | 9.138367 | 7.4489e-20 | 0.137043 | 0.052546 | 91 | 90 | 68 | 7.139 |
| GxSxxD | CcChhH | 52 | 19.9 | 441.1 | 7.34755 | 2.3629e-13 | 0.117887 | 0.045205 | 63 | 68 | 51 | 14.451 |
| SVY | EEE | 38.3 | 14.7 | 601.1 | 6.238409 | 5.0979e-10 | 0.063717 | 0.024433 | 45 | 33 | 14 | 9.333 |
| SxxxH | HhhhH | 315.2 | 120.9 | 1433.7 | 18.46693 | 4.5899e-76 | 0.219851 | 0.084326 | 284 | 367 | 224 | 65.875 |
| RRxG | HHhC | 58 | 22.3 | 215.4 | 7.997367 | 1.5668e-15 | 0.269266 | 0.103372 | 60 | 66 | 53 | 11.393 |
| YxxxI | HhhhC | 40 | 15.4 | 401.6 | 6.397141 | 1.8383e-10 | 0.099602 | 0.038321 | 51 | 50 | 43 | 12.339 |
| IxxS | EccE | 49.9 | 19.2 | 334.1 | 7.209842 | 6.5925e-13 | 0.149356 | 0.057518 | 58 | 50 | 6 | 5.361 |
| RxxGL | HhcCC | 53.5 | 20.6 | 336 | 7.465023 | 9.8050e-14 | 0.159226 | 0.061435 | 64 | 73 | 61 | 6.592 |
| NxxxQ | HhhhC | 82.6 | 31.9 | 264.1 | 9.579875 | 1.2068e-21 | 0.31276 | 0.12071 | 96 | 106 | 83 | 10.611 |
| KxHG | HhCC | 42.9 | 16.6 | 163.8 | 6.820623 | 1.1077e-11 | 0.261905 | 0.101187 | 46 | 45 | 31 | 4.473 |
| WxxxY | HhhhH | 104.8 | 40.6 | 939.3 | 10.30613 | 7.5914e-25 | 0.111572 | 0.043203 | 108 | 124 | 78 | 32.422 |
| YxxxxQ | EecccC | 38.3 | 14.8 | 329 | 6.232553 | 5.3126e-10 | 0.116413 | 0.045103 | 38 | 44 | 35 | 7.961 |
| RxxxxQ | CchhhH | 39 | 15.1 | 262 | 6.321392 | 3.0279e-10 | 0.148855 | 0.057753 | 45 | 46 | 40 | 12.704 |
| RxxxxV | HhhccC | 60.7 | 23.6 | 427.7 | 7.873856 | 3.9908e-15 | 0.141922 | 0.05507 | 76 | 75 | 62 | 13.656 |
| MxxxR | HhhhC | 53.5 | 20.8 | 301.5 | 7.445446 | 1.1360e-13 | 0.177446 | 0.068865 | 68 | 58 | 36 | 10.359 |
| QRG | HCC | 49.4 | 19.2 | 147.2 | 7.401983 | 1.6748e-13 | 0.335598 | 0.130253 | 53 | 54 | 39 | 8.2 |
| SxxAA | HhhHH | 78.9 | 30.6 | 960.7 | 8.862496 | 8.8792e-19 | 0.082128 | 0.031889 | 88 | 93 | 83 | 16.082 |
| MxxxE | CchhH | 292 | 113.4 | 1275.4 | 17.56392 | 5.5301e-69 | 0.228948 | 0.088946 | 304 | 324 | 216 | 51.442 |
| LxxxQ | CchhH | 328 | 127.5 | 1903.8 | 18.38234 | 2.1159e-75 | 0.172287 | 0.066973 | 351 | 403 | 271 | 51.12 |
| RxxxD | ChhhH | 36.4 | 14.2 | 125.1 | 6.27883 | 4.1861e-10 | 0.290967 | 0.113143 | 37 | 45 | 33 | 6.167 |
| SSxxS | HHhhH | 45 | 17.5 | 264.2 | 6.803607 | 1.1954e-11 | 0.170326 | 0.066232 | 52 | 51 | 32 | 6.945 |
| FxxxQ | HhhhH | 322.3 | 125.4 | 2057.5 | 18.15157 | 1.4421e-73 | 0.156646 | 0.060927 | 325 | 351 | 248 | 84.147 |
| QTxxA | HHHhH | 38.6 | 15 | 285.6 | 6.251316 | 4.7151e-10 | 0.135154 | 0.052588 | 40 | 45 | 31 | 10.029 |
| PxN | EhH | 40.1 | 15.6 | 159.8 | 6.523918 | 8.2562e-11 | 0.250939 | 0.097705 | 43 | 47 | 28 | 14.533 |
| LxxxxL | CchhhH | 154.3 | 60.1 | 2989.1 | 12.26441 | 1.5679e-34 | 0.051621 | 0.020122 | 172 | 187 | 154 | 49.359 |
| LxxGA | HhcCC | 40.9 | 16 | 451.2 | 6.360487 | 2.2876e-10 | 0.090647 | 0.035351 | 56 | 60 | 43 | 3.567 |
| HPY | CCC | 40.1 | 15.6 | 184.8 | 6.46315 | 1.2178e-10 | 0.216991 | 0.084649 | 36 | 41 | 21 | 8.774 |
| AxxxxY | CcchhH | 41.9 | 16.4 | 400.6 | 6.451277 | 1.2660e-10 | 0.104593 | 0.040817 | 45 | 47 | 29 | 12.417 |
| KxTG | HhHC | 76.9 | 30 | 329 | 8.978773 | 3.2532e-19 | 0.233739 | 0.091216 | 89 | 88 | 60 | 7.166 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| SPxxxS | ECceeE | 38.1 | 14.9 | 211.2 | 6.24142 | 5.0762e-10 | 0.180398 | 0.070475 | 43 | 28 | 3 | 2 |
| STxxD | CEeeE | 70.3 | 27.5 | 272.3 | 8.618319 | 8.1370e-18 | 0.258171 | 0.100879 | 78 | 26 | 4 | 8.333 |
| ESxG | HHhC | 37.3 | 14.6 | 152.8 | 6.251437 | 4.8643e-10 | 0.24411 | 0.095485 | 44 | 53 | 35 | 5.47 |
| KRG | HHC | 39.6 | 15.5 | 122.7 | 6.553035 | 6.9434e-11 | 0.322738 | 0.126252 | 42 | 45 | 40 | 3 |
| LxxxxE | CchhhH | 64.6 | 25.3 | 535.1 | 8.003582 | 1.3751e-15 | 0.120725 | 0.047287 | 73 | 76 | 64 | 16.419 |
| NxxP | HhcH | 58.9 | 23.1 | 169.6 | 8.014526 | 1.3658e-15 | 0.347288 | 0.136201 | 57 | 64 | 28 | 17.097 |
| WC | CC | 77.2 | 30.3 | 378.1 | 8.889715 | 7.1536e-19 | 0.204179 | 0.080088 | 74 | 86 | 41 | 16.678 |
| DxAxxA | ChHhhH | 40.7 | 16 | 424.8 | 6.30617 | 3.2326e-10 | 0.09581 | 0.037604 | 47 | 50 | 43 | 5.173 |
| EGI | HCC | 38 | 14.9 | 170.6 | 6.252963 | 4.7535e-10 | 0.222743 | 0.087481 | 40 | 46 | 21 | 7.513 |
| ExxxxK | EecceE | 49.3 | 19.4 | 237 | 7.097573 | 1.4863e-12 | 0.208017 | 0.081721 | 53 | 70 | 45 | 9.907 |
| GxxxxS | CcchhH | 154.1 | 60.6 | 1208.3 | 12.32969 | 7.0867e-35 | 0.127535 | 0.050132 | 163 | 180 | 118 | 70.731 |
| SxTxV | HcEeE | 67.5 | 26.5 | 339.7 | 8.277657 | 1.4600e-16 | 0.198705 | 0.078155 | 84 | 28 | 1 | 10.869 |
| GxxxxN | CcchhH | 104.6 | 41.2 | 673.7 | 10.20739 | 2.0976e-24 | 0.155262 | 0.061083 | 120 | 141 | 79 | 47.325 |
| TxxxKK | EeeeEE | 69.9 | 27.5 | 416.3 | 8.363251 | 7.0478e-17 | 0.167908 | 0.066081 | 80 | 17 | 1 | 6.808 |
| YxY | CcE | 84.9 | 33.4 | 504.5 | 9.207153 | 3.8374e-20 | 0.168285 | 0.066298 | 89 | 100 | 48 | 20.439 |
| SxAE | ChHH | 122.9 | 48.4 | 589.8 | 11.16867 | 6.7314e-29 | 0.208376 | 0.082117 | 133 | 148 | 101 | 18.512 |
| ExGF | HcCC | 39.4 | 15.5 | 239.4 | 6.259081 | 4.4518e-10 | 0.164578 | 0.064913 | 53 | 52 | 40 | 6.293 |
| LTS | CCH | 43 | 17 | 240.7 | 6.2855e-11 | 6.2855e-11 | 0.178646 | 0.070463 | 44 | 41 | 21 | 2.257 |
| NDG | ECC | 41.8 | 16.5 | 146.6 | 6.601243 | 4.8788e-11 | 0.28513 | 0.112713 | 43 | 47 | 12 | 10.913 |
| NxxxxF | CccccE | 47.6 | 18.8 | 542.3 | 6.750994 | 1.6369e-11 | 0.087774 | 0.03471 | 49 | 51 | 33 | 10.371 |
| PxxxxQ | CchhhH | 62.2 | 24.6 | 503.6 | 7.77407 | 8.5531e-15 | 0.123511 | 0.048843 | 74 | 81 | 67 | 12.837 |
| RxxxR | HhhhC | 188.3 | 74.5 | 575 | 14.13525 | 2.7770e-45 | 0.327478 | 0.129535 | 207 | 244 | 169 | 47.934 |
| DxAS | ChHH | 45.9 | 18.2 | 275.4 | 6.736084 | 1.8618e-11 | 0.166667 | 0.065934 | 46 | 55 | 42 | 3.25 |
| QSP | EEC | 55.5 | 22 | 358.1 | 7.386743 | 1.7114e-13 | 0.154985 | 0.061328 | 68 | 47 | 8 | 3.5 |
| RRxG | HHcC | 56.3 | 22.3 | 211.9 | 7.619259 | 3.0185e-14 | 0.265691 | 0.105141 | 57 | 66 | 51 | 12.853 |
| LPP | CCH | 51 | 20.2 | 286.8 | 7.109054 | 1.3390e-12 | 0.177824 | 0.070421 | 54 | 62 | 44 | 8.701 |
| SxxxxD | CchhhH | 41.5 | 16.5 | 299.4 | 6.349576 | 2.4419e-10 | 0.138611 | 0.054971 | 42 | 50 | 31 | 10.8 |
| NxxxxN | HhhccC | 60 | 23.8 | 376.7 | 7.661546 | 2.0833e-14 | 0.159278 | 0.063216 | 70 | 77 | 64 | 7.58 |
| NAxxS | HHHhhH | 38.9 | 15.4 | 268.6 | 6.149912 | 8.7835e-10 | 0.144825 | 0.057482 | 38 | 39 | 20 | 3.817 |
| RxTG | HhHC | 45.1 | 17.9 | 213.7 | 6.711082 | 2.2341e-11 | 0.211044 | 0.083822 | 52 | 59 | 49 | 3.924 |
| YxxxF | HhhhH | 151.3 | 60.1 | 2015.5 | 11.93721 | 8.2988e-33 | 0.075068 | 0.029833 | 153 | 168 | 122 | 51.948 |
| VGS | ECC | 50.8 | 20.2 | 338.6 | 7.014581 | 2.6019e-12 | 0.15003 | 0.059706 | 52 | 58 | 33 | 16.101 |
| IxxxxI | CchhhH | 43.8 | 17.4 | 992.1 | 6.369436 | 2.0703e-10 | 0.044149 | 0.017576 | 52 | 56 | 48 | 7.959 |
| SxxVD | CeeEE | 71.1 | 28.4 | 311.2 | 8.413504 | 4.5859e-17 | 0.22847 | 0.091179 | 78 | 27 | 5 | 8 |
| GxxAA | HhhHH | 53.5 | 21.4 | 1130 | 7.01614 | 2.4760e-12 | 0.047345 | 0.018914 | 58 | 70 | 55 | 17.258 |
| MxxxH | HhhhH | 93 | 37.2 | 734.8 | 9.400986 | 5.9947e-21 | 0.126565 | 0.050572 | 95 | 118 | 85 | 36.595 |
| PxDQ | ChHH | 43.8 | 17.5 | 180.6 | 6.602266 | 4.6907e-11 | 0.242525 | 0.097075 | 51 | 57 | 29 | 7.011 |
| CG | CH | 66.5 | 26.7 | 303.6 | 8.076594 | 7.6058e-16 | 0.219038 | 0.087834 | 69 | 78 | 41 | 14.932 |
| SxxxVD | HceeEE | 58.7 | 23.5 | 333.5 | 7.513806 | 4.6429e-14 | 0.176012 | 0.070611 | 74 | 20 | 1 | 9.833 |
| AxxGL | HhcCC | 49.9 | 20 | 437.5 | 6.834044 | 9.1072e-12 | 0.114057 | 0.045773 | 74 | 75 | 65 | 10.817 |
| SSxK | HCeE | 57.9 | 23.2 | 198.2 | 7.653307 | 2.2980e-14 | 0.292129 | 0.117242 | 69 | 32 | 1 | 5.536 |
| ExGG | EeCC | 45.4 | 18.2 | 306.7 | 6.559515 | 6.0218e-11 | 0.148027 | 0.059455 | 44 | 49 | 22 | 6 |
| IxxxxL | CchhhH | 79.6 | 32.1 | 1654.6 | 8.474998 | 2.5182e-17 | 0.048108 | 0.019383 | 92 | 98 | 78 | 19.491 |
| FPxR | CCcC | 41.6 | 16.8 | 246.4 | 6.282883 | 3.7211e-10 | 0.168831 | 0.06804 | 44 | 37 | 27 | 15.541 |
| KxDxK | EeEeE | 78.2 | 31.5 | 395.3 | 8.663783 | 5.1313e-18 | 0.197824 | 0.079765 | 86 | 28 | 3 | 8.808 |
| AxxxxQ | CchhhH | 57.6 | 23.3 | 448.3 | 7.308742 | 2.9604e-13 | 0.128485 | 0.051908 | 61 | 82 | 40 | 11.14 |
| VxxxxR | CchhhH | 75.7 | 30.6 | 650.5 | 8.356763 | 7.0348e-17 | 0.116372 | 0.047016 | 96 | 101 | 80 | 14.641 |
| AxGL | HcCC | 79.5 | 32.1 | 539.5 | 8.617327 | 7.5507e-18 | 0.147359 | 0.059556 | 99 | 101 | 90 | 14.846 |
| EFG | HHC | 47.2 | 19.1 | 189.4 | 6.788653 | 1.2971e-11 | 0.249208 | 0.100739 | 55 | 59 | 41 | 16.85 |
| LxxxxQ | CcchhH | 58.5 | 23.7 | 469.2 | 7.336592 | 2.3940e-13 | 0.12468 | 0.050508 | 68 | 72 | 61 | 11.976 |
| RSxG | HHC | 54.3 | 22 | 224.4 | 7.250022 | 4.7424e-13 | 0.241979 | 0.098051 | 60 | 66 | 47 | 6.848 |
| YxxxxS | HhhhcC | 44.5 | 18 | 410.7 | 6.372091 | 2.0302e-10 | 0.108352 | 0.04392 | 56 | 56 | 45 | 12.558 |
| AxxAA | HhhHC | 61.6 | 25 | 435.1 | 7.54746 | 4.8688e-14 | 0.141577 | 0.057408 | 79 | 83 | 77 | 14.553 |
| YxxxN | HhhhC | 131.6 | 53.4 | 626.1 | 11.19454 | 4.8487e-29 | 0.21019 | 0.085253 | 138 | 164 | 107 | 10.14 |
| NExxR | HHHhH | 68.6 | 27.9 | 378.6 | 7.9956 | 1.4251e-15 | 0.181194 | 0.073776 | 74 | 84 | 53 | 12.711 |
| YxxxY | HhhhH | 208.5 | 84.9 | 1723.4 | 13.75447 | 5.1591e-43 | 0.120982 | 0.049272 | 217 | 240 | 173 | 68.563 |
| TxxxR | HhhhC | 81.7 | 33.3 | 353.9 | 8.818101 | 1.3071e-18 | 0.230856 | 0.094038 | 93 | 98 | 74 | 13.874 |
| RxxxxE | HhhccC | 173.9 | 70.9 | 874 | 12.7612 | 2.9847e-37 | 0.19897 | 0.08112 | 195 | 205 | 162 | 32.84 |
| LxxxV | CchhH | 94.4 | 38.5 | 929.9 | 9.198796 | 3.8794e-20 | 0.101516 | 0.041413 | 93 | 96 | 68 | 17.959 |
| RExG | HHhC | 92.3 | 37.7 | 353.8 | 9.41839 | 5.1848e-21 | 0.260882 | 0.106451 | 103 | 113 | 87 | 24.407 |
| VxxxxQ | CcchhH | 56.1 | 22.9 | 488.3 | 7.10183 | 1.3279e-12 | 0.114888 | 0.046923 | 78 | 85 | 68 | 8.301 |
| ExxGL | HhcCC | 64.7 | 26.4 | 437.9 | 7.674219 | 1.8107e-14 | 0.147751 | 0.060392 | 82 | 83 | 73 | 10.513 |
| TPxxxK | CHhhhH | 42.6 | 17.4 | 322 | 6.202797 | 6.0232e-10 | 0.132298 | 0.054102 | 49 | 49 | 34 | 12.211 |
| RxxxF | HhhhC | 42.6 | 17.4 | 230.1 | 6.267413 | 4.0522e-10 | 0.185137 | 0.075788 | 43 | 51 | 42 | 5.093 |
| RxxQ | ChhH | 123 | 50.4 | 388.2 | 10.96953 | 6.1545e-28 | 0.316847 | 0.129758 | 136 | 158 | 98 | 25.056 |
| FxxxQ | HhhhC | 50.5 | 20.7 | 311.9 | 6.783616 | 1.2804e-11 | 0.161911 | 0.066325 | 63 | 69 | 53 | 10.301 |
| KDxG | HHhC | 61.6 | 25.2 | 236 | 7.660531 | 2.0910e-14 | 0.261017 | 0.106924 | 64 | 75 | 50 | 10.466 |
| YxxxR | HhhhH | 507.9 | 207.9 | 2808.6 | 21.59003 | 2.4287e-103 | 0.180695 | 0.074032 | 523 | 598 | 413 | 103.922 |
| WxxxR | HhhhH | 205.3 | 84.2 | 1244.6 | 13.6702 | 1.6585e-42 | 0.164953 | 0.067642 | 211 | 254 | 169 | 61.82 |
| KxFG | HhHC | 43.8 | 18 | 249.9 | 6.320153 | 2.8637e-10 | 0.17527 | 0.071956 | 55 | 60 | 51 | 10.832 |
| KxxGV | HhhCC | 49.3 | 20.3 | 325.6 | 6.663139 | 2.9074e-11 | 0.151413 | 0.062217 | 63 | 66 | 54 | 13.445 |
| QKxG | HHhC | 50.3 | 20.7 | 190.7 | 6.89803 | 5.9432e-12 | 0.263765 | 0.108445 | 58 | 60 | 48 | 8.676 |
| GxxxxR | CchhhH | 118.7 | 48.8 | 850.2 | 10.29793 | 7.7223e-25 | 0.139614 | 0.057438 | 126 | 137 | 107 | 23 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| QExG | HHhC | 44.7 | 18.4 | 194.8 | 6.446972 | 1.2707e−10 | 0.229466 | 0.094406 | 55 | 52 | 44 | 11.216 |
| NxxxxK | CchhhH | 81.3 | 33.5 | 456 | 8.591494 | 9.3418e−18 | 0.178289 | 0.073378 | 93 | 109 | 78 | 16.967 |
| FxxxN | HhhhH | 179.4 | 73.9 | 1396.3 | 12.61498 | 1.8611e−36 | 0.128482 | 0.05291 | 198 | 228 | 158 | 40.24 |
| AxxQS | HhhHH | 45.5 | 18.8 | 322.8 | 6.35022 | 2.3121e−10 | 0.140954 | 0.058203 | 52 | 53 | 48 | 10.166 |
| TEA | CHH | 96 | 39.7 | 292.4 | 9.607131 | 8.5115e−22 | 0.328317 | 0.13583 | 92 | 114 | 61 | 11.498 |
| YxxxT | EcccE | 41.1 | 17 | 171.8 | 6.153075 | 8.4367e−10 | 0.239232 | 0.099017 | 47 | 53 | 13 | 6.453 |
| TKxxK | EEeeE | 96 | 39.8 | 398.3 | 9.392073 | 6.4809e−21 | 0.241024 | 0.099903 | 109 | 33 | 4 | 11.141 |
| AxxAA | HhhHH | 232.6 | 96.4 | 3380.2 | 14.07095 | 5.9399e−45 | 0.068812 | 0.028524 | 260 | 292 | 237 | 37.003 |
| ExxxF | HhhhC | 51.9 | 21.5 | 296.5 | 6.797281 | 1.1516e−11 | 0.175042 | 0.072608 | 60 | 71 | 51 | 13.323 |
| LSxxE | CChhH | 117.4 | 48.7 | 851.8 | 10.13758 | 3.9929e−24 | 0.137826 | 0.057178 | 131 | 149 | 113 | 25.064 |
| SAA | CHH | 97.7 | 40.5 | 376.8 | 9.504205 | 2.2325e−21 | 0.259289 | 0.10758 | 104 | 111 | 64 | 12.337 |
| DxxxxQ | CchhhH | 68.3 | 28.3 | 458.4 | 7.749134 | 9.8809e−15 | 0.148997 | 0.061827 | 79 | 86 | 64 | 16.775 |
| EAxxxQ | HHhhhH | 45.2 | 18.8 | 422.8 | 6.237266 | 4.7014e−10 | 0.106906 | 0.044414 | 47 | 52 | 42 | 11.095 |
| FxN | ChH | 67.5 | 28 | 272.3 | 7.865817 | 4.0460e−15 | 0.247888 | 0.103 | 67 | 74 | 34 | 17.384 |
| TxNG | EeCC | 49.7 | 20.7 | 275.2 | 6.622482 | 3.8018e−11 | 0.180596 | 0.075273 | 51 | 58 | 42 | 8.901 |
| HxxxQ | HhhhH | 327.4 | 136.5 | 1404.3 | 17.19861 | 2.9556e−66 | 0.233141 | 0.097192 | 328 | 400 | 272 | 59.385 |
| HxxxN | HhhhH | 195.7 | 81.6 | 841.4 | 13.28816 | 2.9476e−40 | 0.232589 | 0.097006 | 204 | 230 | 159 | 45.887 |
| NxxxR | HhhhH | 648.3 | 270.4 | 2518.1 | 24.32263 | 1.2367e−130 | 0.257456 | 0.107389 | 610 | 743 | 462 | 158.253 |
| NGI | CCE | 49.4 | 20.6 | 260.4 | 6.597702 | 4.4957e−11 | 0.189708 | 0.079259 | 53 | 51 | 42 | 13.4 |
| DKxG | HHhC | 59.5 | 24.9 | 228.9 | 7.356353 | 2.0816e−13 | 0.259939 | 0.108634 | 67 | 74 | 39 | 13.515 |
| SxxxxY | ChhhhH | 66 | 27.6 | 674.7 | 7.466487 | 8.5770e−14 | 0.097821 | 0.040894 | 75 | 86 | 69 | 24.58 |
| DAxxR | CHhhH | 47.2 | 19.7 | 267.6 | 6.420888 | 1.4506e−10 | 0.176383 | 0.073777 | 49 | 43 | 20 | 16.283 |
| HxxxY | HhhhH | 136.7 | 57.2 | 1013.4 | 10.82597 | 2.7198e−27 | 0.134892 | 0.056424 | 146 | 162 | 94 | 52.442 |
| SxTK | HcEE | 87.3 | 36.5 | 320.2 | 8.926379 | 4.8515e−19 | 0.272642 | 0.114065 | 104 | 44 | 2 | 10.869 |
| RxxxF | HhccC | 95.2 | 40 | 501.8 | 9.091054 | 1.0429e−19 | 0.189717 | 0.079765 | 107 | 113 | 90 | 32.509 |
| SxxAQ | HhhHH | 48.8 | 20.5 | 367.6 | 6.420944 | 1.4190e−10 | 0.132753 | 0.05585 | 54 | 59 | 41 | 8.195 |
| EGG | ECC | 45.7 | 19.2 | 174.1 | 6.394959 | 1.7583e−10 | 0.262493 | 0.110529 | 50 | 56 | 38 | 7.878 |
| LxxxxY | HhhccC | 53.2 | 22.4 | 957.7 | 6.577507 | 4.8789e−11 | 0.05555 | 0.023412 | 58 | 53 | 45 | 13.611 |
| ExTG | HhHC | 52.2 | 22 | 309.4 | 6.677412 | 2.5699e−11 | 0.168714 | 0.071133 | 61 | 72 | 54 | 7.579 |
| STxV | CEeE | 79.7 | 33.6 | 368.4 | 8.33438 | 8.3322e−17 | 0.216341 | 0.091281 | 88 | 33 | 6 | 6.767 |
| GxxxL | ChhhC | 45.7 | 19.3 | 438.5 | 6.14382 | 8.3292e−10 | 0.104219 | 0.044027 | 54 | 50 | 31 | 5.267 |
| PxxAA | HhhHH | 66 | 27.9 | 816.2 | 7.342254 | 2.1476e−13 | 0.080863 | 0.034173 | 74 | 82 | 64 | 11.664 |
| YxxxQ | HhhhH | 376.9 | 159.4 | 2150.4 | 17.90893 | 1.0512e−71 | 0.17527 | 0.074107 | 374 | 436 | 305 | 111.215 |
| DxxxxR | CchhhH | 136.7 | 58 | 811.5 | 10.71836 | 8.6960e−27 | 0.168453 | 0.071505 | 143 | 168 | 128 | 34.131 |
| HxH | ChH | 49.4 | 21 | 166.4 | 6.637432 | 3.4999e−11 | 0.296871 | 0.126078 | 48 | 58 | 40 | 14.723 |
| PxxxxQ | CcchhH | 109.4 | 46.5 | 1083.7 | 9.42162 | 4.5216e−21 | 0.10095 | 0.042935 | 118 | 135 | 95 | 24.269 |
| SxExxR | ChHhhH | 62.2 | 26.5 | 481.7 | 7.130862 | 1.0256e−12 | 0.129126 | 0.055033 | 80 | 87 | 70 | 14.016 |
| SGxxxD | EEeccE | 50.1 | 21.4 | 292.4 | 6.4458 | 1.1982e−10 | 0.171341 | 0.073174 | 60 | 62 | 3 | 2 |
| AxxAS | HhhHH | 77.3 | 33.1 | 862.3 | 7.834917 | 4.7308e−15 | 0.089644 | 0.038384 | 98 | 95 | 79 | 12.6 |
| AxxRR | HhhHH | 119 | 51 | 722.4 | 9.873794 | 5.5640e−23 | 0.164729 | 0.070617 | 129 | 147 | 115 | 15.089 |
| NxxxxE | CcchhH | 188.1 | 80.7 | 1090.7 | 12.43087 | 1.8292e−35 | 0.172458 | 0.073955 | 206 | 216 | 153 | 32.263 |
| RKxG | HHhC | 59.6 | 25.6 | 254 | 7.09804 | 1.3380e−12 | 0.234646 | 0.10065 | 67 | 79 | 54 | 6.282 |
| RxxxE | CchhhC | 60.4 | 25.9 | 383.1 | 7.017736 | 2.3228e−12 | 0.157661 | 0.067628 | 75 | 91 | 59 | 8.743 |
| LxxxxV | HhhccC | 66.2 | 28.4 | 1605.3 | 7.15494 | 8.3081e−13 | 0.041238 | 0.017695 | 82 | 92 | 77 | 17.354 |
| WxxxE | HhhhH | 212.2 | 91.1 | 1285.6 | 13.16755 | 1.3835e−39 | 0.165059 | 0.07084 | 221 | 251 | 188 | 46.713 |
| QxxxN | HhhhH | 782.6 | 336.4 | 3046.6 | 25.79586 | 1.0406e−146 | 0.256877 | 0.110409 | 762 | 926 | 577 | 115.112 |
| YxxxxD | HhccC | 49.9 | 21.5 | 413.3 | 6.306176 | 2.9083e−10 | 0.120736 | 0.051916 | 58 | 62 | 47 | 19.646 |
| PxW | ChH | 79.8 | 34.3 | 415 | 8.106427 | 5.4043e−16 | 0.192289 | 0.082693 | 81 | 103 | 66 | 17.843 |
| AxxQD | HhhHH | 65.9 | 28.4 | 324.1 | 7.377042 | 1.6844e−13 | 0.203332 | 0.087528 | 67 | 71 | 29 | 16.326 |
| WPS | CCC | 53.8 | 23.2 | 328.9 | 6.603471 | 4.1321e−11 | 0.163576 | 0.070417 | 57 | 62 | 15 | 16.457 |
| QxxxR | HhhhC | 139 | 60 | 517.3 | 10.84212 | 2.2965e−27 | 0.268703 | 0.116603 | 151 | 185 | 120 | 21.397 |
| QxxxxL | HhhccC | 57.2 | 24.7 | 531.5 | 6.693205 | 2.1962e−11 | 0.10762 | 0.046493 | 73 | 74 | 64 | 14.227 |
| PxxxN | HhhC | 62.1 | 26.8 | 260.5 | 7.184689 | 7.0636e−13 | 0.238113 | 0.102927 | 59 | 74 | 51 | 15.003 |
| GxTxxE | CcChhH | 54.9 | 23.8 | 506.5 | 6.54652 | 5.9175e−11 | 0.108391 | 0.046894 | 65 | 71 | 59 | 5 |
| AxxRD | HhhHH | 77.3 | 33.4 | 420.4 | 7.9035 | 2.7836e−15 | 0.183873 | 0.07956 | 91 | 98 | 81 | 17.109 |
| IxxxxE | CcchhH | 74.6 | 32.3 | 754.4 | 7.611808 | 2.7000e−14 | 0.098887 | 0.042796 | 93 | 95 | 87 | 13.777 |
| LTxxE | CChhH | 100.6 | 43.5 | 866 | 8.87308 | 7.1316e−19 | 0.116166 | 0.050279 | 114 | 121 | 90 | 17.283 |
| DxxRR | HhhHH | 121.9 | 52.8 | 600.5 | 9.963409 | 2.2695e−23 | 0.202998 | 0.087883 | 141 | 150 | 131 | 22.814 |
| RAxxxR | HHhhhH | 62.9 | 27.3 | 536.8 | 6.997202 | 2.6193e−12 | 0.117176 | 0.050836 | 68 | 75 | 64 | 10.493 |
| ExFG | HhhC | 57 | 24.7 | 365.9 | 6.717061 | 1.8836e−11 | 0.15578 | 0.067613 | 73 | 82 | 64 | 7.303 |
| HxxR | HhcC | 76.9 | 33.4 | 263.5 | 8.056204 | 8.3542e−16 | 0.291841 | 0.126735 | 84 | 94 | 67 | 23.162 |
| ExxxY | HhhhC | 61.4 | 26.7 | 310.7 | 7.030848 | 2.1101e−12 | 0.197618 | 0.085867 | 71 | 83 | 64 | 13.696 |
| SxQE | ChHH | 54.8 | 23.8 | 271.3 | 6.647848 | 3.0642e−11 | 0.20199 | 0.08778 | 65 | 72 | 58 | 10.729 |
| GxxxxR | CcchhH | 133.1 | 57.9 | 856.2 | 10.24474 | 1.2603e−24 | 0.155454 | 0.067572 | 154 | 174 | 129 | 29.99 |
| KxxW | CchH | 52.9 | 23 | 222 | 6.582378 | 4.8269e−11 | 0.238288 | 0.103638 | 58 | 59 | 26 | 16.589 |
| QxxxQ | HhhhC | 119.4 | 51.9 | 424.3 | 9.99265 | 1.7280e−23 | 0.281405 | 0.122406 | 145 | 169 | 131 | 14.893 |
| QAxxS | HHhhH | 58.8 | 25.6 | 440.6 | 6.767101 | 1.3211e−11 | 0.133454 | 0.058061 | 69 | 60 | 44 | 7.414 |
| ExxxxY | HhccC | 53.4 | 23.3 | 395.2 | 6.443766 | 1.1723e−10 | 0.135121 | 0.058842 | 68 | 76 | 65 | 18.62 |
| SxSE | ChHH | 61.7 | 26.9 | 315.1 | 7.001886 | 2.5790e−12 | 0.195811 | 0.085508 | 64 | 72 | 60 | 13.789 |
| IxxxN | HhhhH | 403.8 | 176.6 | 2697.7 | 17.68693 | 5.2702e−70 | 0.149683 | 0.065459 | 446 | 502 | 358 | 79.725 |
| ADG | HCC | 52.2 | 22.8 | 214.2 | 6.502539 | 8.1955e−11 | 0.243697 | 0.106591 | 57 | 62 | 34 | 3.587 |
| FxxxC | HhhhH | 53 | 23.2 | 1300.9 | 6.246268 | 4.0873e−10 | 0.040741 | 0.017826 | 59 | 63 | 47 | 15.836 |
| FxxxH | HhhC | 50.3 | 22 | 431 | 6.187233 | 6.0903e−10 | 0.116705 | 0.051087 | 61 | 67 | 57 | 11.829 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Probability | Num Crystal Sets | Num Interface Intersets | Num Chain-sets 25 | Non-Water Solvent |
|---|---|---|---|---|---|---|---|---|---|---|---|---|
| NxxxxS | CcchhH | 59.7 | 26.1 | 436.5 | 6.769024 | 1.2951e−11 | 0.13677 | 0.059891 | 63 | 71 | 57 | 21.808 |
| ISxE | CChH | 56.6 | 24.8 | 386.1 | 6.605482 | 3.9718e−11 | 0.146594 | 0.064198 | 65 | 62 | 55 | 4.591 |
| TxxxxE | CcchhH | 153.7 | 67.3 | 1094.5 | 10.86893 | 1.6117e−27 | 0.140429 | 0.061501 | 174 | 194 | 152 | 29.804 |
| YxxxL | HhhhH | 540.6 | 236.8 | 6880.9 | 20.08853 | 9.0430e−90 | 0.078565 | 0.034417 | 570 | 655 | 461 | 161.173 |
| IxxxT | CchhH | 78.9 | 34.6 | 681.3 | 7.739718 | 9.8608e−15 | 0.115808 | 0.050735 | 83 | 86 | 62 | 31.31 |
| QxxxD | HhhhH | 1521.3 | 666.8 | 5548.2 | 35.2777 | 1.3372e−272 | 0.274197 | 0.120187 | 1434 | 1841 | 1141 | 196.522 |
| KxDK | EeEE | 103.4 | 45.3 | 400.6 | 9.155613 | 5.5926e−20 | 0.258113 | 0.113187 | 114 | 39 | 4 | 10.641 |
| SxKV | CeEE | 74.8 | 32.8 | 361.7 | 7.687742 | 1.5248e−14 | 0.206801 | 0.090709 | 80 | 29 | 3 | 8.036 |
| QxxAA | HhhHH | 119.9 | 52.6 | 1024 | 9.528485 | 1.5740e−21 | 0.11709 | 0.051362 | 138 | 153 | 120 | 19.495 |
| ExxRL | HhhHH | 194.4 | 85.3 | 1592.4 | 12.14393 | 6.0904e−34 | 0.12208 | 0.053562 | 211 | 224 | 175 | 28.72 |
| PxxH | ChhH | 61.7 | 27.1 | 261.6 | 7.012657 | 2.4020e−12 | 0.235856 | 0.103682 | 62 | 80 | 54 | 9.925 |
| SxxQA | HhhHH | 53.7 | 23.6 | 382.6 | 6.394275 | 1.6075e−10 | 0.140355 | 0.0617 | 55 | 66 | 46 | 13.703 |
| LSxxE | HHhhH | 56.5 | 24.8 | 444.2 | 6.537592 | 6.2004e−11 | 0.127195 | 0.055922 | 65 | 68 | 59 | 13 |
| TKxxxK | EEeeE | 67 | 29.5 | 480.9 | 7.130159 | 9.9543e−13 | 0.139322 | 0.061317 | 77 | 18 | 2 | 5.808 |
| QxxxxE | CcchhH | 111.8 | 49.3 | 708.3 | 9.23359 | 2.6009e−20 | 0.157843 | 0.069571 | 125 | 135 | 91 | 12.001 |
| YxxxR | HhhhC | 88.3 | 39 | 494.7 | 8.228505 | 1.8953e−16 | 0.178492 | 0.07881 | 114 | 123 | 99 | 13.731 |
| SxY | ChH | 163.2 | 72.1 | 829.5 | 11.22067 | 3.2336e−29 | 0.196745 | 0.086964 | 159 | 192 | 116 | 32.32 |
| TxAE | ChHH | 127.2 | 56.2 | 609.9 | 9.932803 | 3.0165e−23 | 0.208559 | 0.092199 | 139 | 163 | 100 | 18.244 |
| AxxxxI | HhhccC | 52.8 | 23.3 | 1142.1 | 6.160343 | 6.9870e−10 | 0.046231 | 0.020438 | 78 | 79 | 68 | 18.502 |
| NxxE | EhhH | 79.8 | 35.3 | 312.4 | 7.94677 | 1.9603e−15 | 0.255442 | 0.113064 | 87 | 91 | 49 | 14.814 |
| YPS | CCC | 75.2 | 33.3 | 377 | 7.598203 | 3.0137e−14 | 0.199469 | 0.088388 | 78 | 73 | 52 | 18.633 |
| YxxxS | HhhhC | 68.2 | 30.2 | 392.2 | 7.190393 | 6.4338e−13 | 0.173891 | 0.077062 | 77 | 87 | 68 | 19.096 |
| NxxxQ | HhhhH | 622.8 | 276.1 | 2608.8 | 22.07021 | 6.1727e−108 | 0.23873 | 0.105815 | 600 | 741 | 460 | 139.721 |
| ExxxxR | CchhhH | 96.4 | 42.8 | 631.6 | 8.492481 | 1.9932e−17 | 0.152628 | 0.067721 | 108 | 133 | 90 | 12.676 |
| RxxxAE | HhhhHH | 57.2 | 25.4 | 630.5 | 6.432535 | 1.2154e−10 | 0.090722 | 0.040326 | 59 | 65 | 55 | 14.205 |
| AExxS | HHHhH | 69 | 30.7 | 525.3 | 7.131241 | 9.7365e−13 | 0.131354 | 0.058394 | 79 | 89 | 71 | 7.484 |
| HxxL | HhhC | 56.6 | 25.2 | 374.6 | 6.485005 | 8.7495e−11 | 0.151095 | 0.067203 | 63 | 70 | 47 | 11.112 |
| GxxxxE | CchhhH | 70.2 | 31.2 | 512.7 | 7.194858 | 6.1244e−13 | 0.136922 | 0.06092 | 79 | 98 | 68 | 10.557 |
| HxxxR | HhhhH | 321.8 | 143.5 | 1583.7 | 15.60741 | 6.4283e−55 | 0.203195 | 0.090614 | 325 | 388 | 273 | 61.605 |
| ExxRR | HhhhH | 299.8 | 133.8 | 1539.6 | 15.02431 | 5.0311e−51 | 0.194720 | 0.086878 | 327 | 382 | 294 | 72.254 |
| ARxxQ | HHhhH | 63.9 | 28.5 | 473.6 | 6.834976 | 8.0075e−12 | 0.134924 | 0.060212 | 67 | 74 | 52 | 15.525 |
| QxxxG | HhhhC | 264.2 | 118.1 | 1288.7 | 14.10751 | 3.3809e−45 | 0.205013 | 0.091634 | 274 | 318 | 203 | 46.677 |
| LxxxH | HhhhH | 363.9 | 162.7 | 3238 | 16.18427 | 6.2530e−59 | 0.112384 | 0.05025 | 367 | 465 | 281 | 141.562 |
| SPxxL | ECceE | 58.9 | 26.4 | 269 | 6.675323 | 2.4694e−11 | 0.218959 | 0.097969 | 66 | 43 | 3 | 5 |
| NxED | ChhH | 68.8 | 30.8 | 317.4 | 7.204843 | 5.8007e−13 | 0.216761 | 0.097047 | 68 | 76 | 56 | 7.524 |
| YxxxR | CchhH | 55.5 | 24.9 | 290.4 | 6.425431 | 1.3030e−10 | 0.191116 | 0.085617 | 59 | 64 | 49 | 11.822 |
| QxxxR | HhhhH | 1090.8 | 488.7 | 4100.8 | 29.02094 | 3.6056e−185 | 0.265997 | 0.11917 | 1033 | 1295 | 830 | 179.836 |
| IxxE | EccE | 51.4 | 23 | 281.9 | 6.168465 | 6.8170e−10 | 0.182334 | 0.081702 | 58 | 59 | 43 | 6.574 |
| AxxxxV | HhhccV | 75.2 | 33.7 | 1390.6 | 7.236538 | 4.3596e−13 | 0.054077 | 0.024235 | 109 | 116 | 95 | 16.603 |
| SxxxxQ | CcchhH | 97.8 | 43.8 | 663.1 | 8.432856 | 3.2796e−17 | 0.147489 | 0.066115 | 119 | 126 | 102 | 10.513 |
| TxxDK | EeeEE | 91.2 | 40.9 | 412.9 | 8.290419 | 1.1242e−16 | 0.220877 | 0.099016 | 103 | 25 | 2 | 11.391 |
| KxxDG | EccCC | 71.2 | 31.9 | 339.7 | 7.29748 | 2.9121e−13 | 0.209597 | 0.094033 | 89 | 96 | 74 | 13.514 |
| WxxxT | HhhhH | 96.5 | 43.3 | 984.1 | 8.269284 | 1.2892e−16 | 0.098059 | 0.043997 | 110 | 112 | 80 | 31.021 |
| RxxxxR | EccccC | 59.9 | 26.9 | 352.7 | 6.623809 | 3.4346e−11 | 0.169833 | 0.076235 | 63 | 68 | 45 | 10.813 |
| ExxGL | HhhCC | 56.2 | 25.2 | 392.3 | 6.371708 | 1.8190e−10 | 0.143258 | 0.064332 | 65 | 70 | 61 | 6.371 |
| DxxxxQ | CcchhH | 85.9 | 38.7 | 553.6 | 7.871355 | 3.4039e−15 | 0.155166 | 0.069878 | 98 | 107 | 90 | 14.997 |
| FxxxR | HhhhH | 380.5 | 171.4 | 2686.2 | 16.50728 | 3.1248e−61 | 0.14165 | 0.063807 | 403 | 441 | 312 | 92.055 |
| TKxD | EEeE | 103.5 | 46.7 | 416.7 | 8.823218 | 1.1095e−18 | 0.24838 | 0.112045 | 117 | 40 | 4 | 13.641 |
| LxxxE | CchhH | 488.7 | 220.5 | 3253.3 | 18.7016 | 4.6170e−78 | 0.150217 | 0.067791 | 535 | 608 | 440 | 81.17 |
| RxxxR | HhhhH | 1627.7 | 735 | 5837.9 | 35.21812 | 1.0581e−271 | 0.278816 | 0.125905 | 1405 | 1795 | 1078 | 376.551 |
| FxxxS | HhhhH | 203 | 91.7 | 2171.4 | 11.87273 | 1.5498e−32 | 0.093488 | 0.04224 | 223 | 240 | 192 | 43.44 |
| ExxT | EccE | 55 | 24.9 | 180.7 | 6.491457 | 8.6501e−11 | 0.304372 | 0.137879 | 54 | 68 | 36 | 9.01 |
| IxxxR | CchhH | 71.2 | 32.3 | 512.5 | 7.082769 | 1.3566e−12 | 0.138927 | 0.062944 | 76 | 87 | 67 | 18.638 |
| FxxxY | HhhhH | 156.2 | 70.9 | 2194.5 | 10.29735 | 6.7695e−25 | 0.071178 | 0.03231 | 176 | 182 | 141 | 69.566 |
| YxxxxK | EeeccC | 59.1 | 26.8 | 527.3 | 6.393258 | 1.5451e−10 | 0.11208 | 0.050894 | 65 | 70 | 51 | 15.317 |
| QxxxQ | HhhhH | 1076.2 | 488.7 | 4171 | 28.28569 | 5.1236e−176 | 0.25802 | 0.117162 | 997 | 1232 | 812 | 173.938 |
| RxxxxL | HhhccC | 95.2 | 43.3 | 774.6 | 8.128103 | 4.1443e−16 | 0.122902 | 0.055843 | 114 | 129 | 103 | 14.173 |
| NxxxxQ | CcchhH | 89.8 | 40.8 | 601.9 | 7.943062 | 1.8903e−15 | 0.149194 | 0.0678 | 99 | 109 | 83 | 27.066 |
| AxxAQ | HhhHH | 79.5 | 36.2 | 761.4 | 7.381135 | 1.4828e−13 | 0.104413 | 0.04751 | 84 | 92 | 74 | 11.5 |
| SxM | ChH | 80.7 | 36.8 | 401.4 | 7.605818 | 2.7538e−14 | 0.201046 | 0.09156 | 79 | 91 | 63 | 19.888 |
| VGG | ECC | 71.2 | 32.4 | 623.7 | 6.989302 | 2.6159e−12 | 0.114157 | 0.052013 | 85 | 99 | 59 | 13.694 |
| MxxxN | HhhhH | 155.3 | 70.8 | 1069.5 | 10.40015 | 2.3558e−25 | 0.145208 | 0.066161 | 170 | 189 | 149 | 41.172 |
| HxxxxD | CcchhH | 56.9 | 25.9 | 444.9 | 6.267277 | 3.4999e−10 | 0.127894 | 0.058283 | 64 | 69 | 42 | 13.693 |
| PxG | HhC | 90.2 | 41.1 | 292 | 8.254118 | 1.5418e−16 | 0.308904 | 0.140865 | 87 | 103 | 72 | 16.132 |
| RxxxxL | HhhhcC | 87.5 | 39.9 | 702.4 | 7.752774 | 8.5135e−15 | 0.124573 | 0.056842 | 107 | 115 | 88 | 22.073 |
| SLxxE | HHhhH | 67.4 | 30.8 | 603.2 | 6.778556 | 1.1465e−11 | 0.111737 | 0.051012 | 71 | 76 | 58 | 13.349 |
| TxxQ | EhhH | 58.8 | 26.9 | 230.1 | 6.560384 | 5.3148e−11 | 0.255541 | 0.116691 | 61 | 71 | 49 | 12.494 |
| QxxDA | HhhHH | 63.6 | 29.1 | 395.9 | 6.658707 | 2.6485e−11 | 0.160647 | 0.073381 | 67 | 69 | 46 | 14.471 |
| FxxxN | HhhhC | 91 | 41.6 | 668.6 | 7.907795 | 2.4834e−15 | 0.136105 | 0.062228 | 104 | 116 | 92 | 17.061 |
| QxxxxP | HhhccC | 70.8 | 32.4 | 471.6 | 6.990638 | 2.6072e−12 | 0.150127 | 0.068702 | 88 | 89 | 70 | 11.521 |
| SPxS | ECcE | 55.3 | 25.3 | 221.9 | 6.331376 | 2.3956e−10 | 0.249211 | 0.114087 | 62 | 38 | 7 | 4 |
| QxxxH | HhhhH | 270.5 | 123.8 | 1263.5 | 13.8755 | 8.6154e−44 | 0.214088 | 0.098019 | 276 | 333 | 215 | 63.926 |
| NxxQ | ChhH | 332 | 152.1 | 1273.8 | 15.54405 | 1.7117e−54 | 0.260637 | 0.11941 | 328 | 391 | 253 | 68.333 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| ExxxAE | HhhhHH | 82.6 | 37.8 | 768.2 | 7.460296 | 8.0982e−14 | 0.107524 | 0.049269 | 90 | 97 | 82 | 15.236 |
| WxR | EcC | 53.9 | 24.7 | 209.1 | 6.256836 | 3.8814e−10 | 0.257771 | 0.11812 | 53 | 64 | 36 | 20.081 |
| HxxxE | HhhhH | 519.1 | 238.2 | 2247.4 | 19.25348 | 1.2780e−82 | 0.230978 | 0.10597 | 518 | 620 | 389 | 108.313 |
| AxxLQ | HhhHH | 64.5 | 29.6 | 881.6 | 6.524433 | 6.3403e−11 | 0.073162 | 0.033578 | 62 | 57 | 47 | 5.807 |
| NTK | CEE | 60.7 | 27.9 | 192.9 | 6.723444 | 1.7833e−11 | 0.314671 | 0.144478 | 65 | 35 | 7 | 7.334 |
| YxxxxG | EecccC | 128.5 | 59.1 | 1454.7 | 9.226183 | 2.6007e−20 | 0.088334 | 0.040595 | 147 | 156 | 100 | 35.882 |
| DxxxxR | CcchhH | 80.6 | 37.1 | 502.2 | 7.433222 | 1.0069e−13 | 0.160494 | 0.073783 | 94 | 110 | 77 | 21.917 |
| VDKK | EEEE | 78.6 | 36.1 | 374.6 | 7.42806 | 1.0634e−13 | 0.209824 | 0.0965 | 90 | 26 | 1 | 8.308 |
| SxxxxE | CcchhH | 192.1 | 88.4 | 1305.4 | 11.42485 | 2.9571e−30 | 0.147158 | 0.06771 | 218 | 247 | 163 | 34.29 |
| NxF | ChH | 105.6 | 48.6 | 612.6 | 8.517471 | 1.5500e−17 | 0.17238 | 0.079361 | 111 | 102 | 68 | 30.672 |
| PxxxxR | CchhhH | 112.2 | 51.7 | 866.2 | 8.68564 | 3.5307e−18 | 0.129531 | 0.059641 | 127 | 145 | 107 | 30.249 |
| SxAD | ChHH | 93.1 | 42.9 | 534.3 | 7.998864 | 1.1948e−15 | 0.174247 | 0.080239 | 105 | 105 | 80 | 26.811 |
| ExxxR | HhhhH | 3545.7 | 1634.5 | 12751.1 | 50.62821 | 0.0000e+00 | 0.27807 | 0.128187 | 3009 | 4163 | 2328 | 605.848 |
| RxxV | HhhC | 93.3 | 43 | 530.2 | 7.995811 | 1.2235e−15 | 0.175971 | 0.08115 | 104 | 114 | 95 | 19.625 |
| RxxxQ | HhhhC | 158.8 | 73.3 | 541.1 | 10.74695 | 6.0389e−27 | 0.293476 | 0.135401 | 191 | 217 | 149 | 24.372 |
| RxxDG | EccCC | 67.2 | 31 | 359.2 | 6.792614 | 1.0513e−11 | 0.187082 | 0.086392 | 84 | 88 | 64 | 12.849 |
| TxxxQ | HhhhH | 624.6 | 288.5 | 2880.6 | 20.86151 | 1.1458e−96 | 0.21683 | 0.100147 | 598 | 678 | 467 | 118.683 |
| YxxxxK | HhhhcC | 68.3 | 31.5 | 611.7 | 6.718956 | 1.7065e−11 | 0.111656 | 0.051574 | 78 | 84 | 69 | 13.984 |
| SxxxxS | CcchhH | 63.2 | 29.2 | 600.9 | 6.451142 | 1.0335e−10 | 0.105176 | 0.048591 | 69 | 80 | 60 | 31.067 |
| AxxAR | HhhHH | 118.4 | 54.8 | 1244.1 | 8.783439 | 1.4619e−18 | 0.095169 | 0.044062 | 130 | 140 | 111 | 22.224 |
| AAxxQ | HHhhH | 100.7 | 46.6 | 848.8 | 8.140927 | 3.6432e−16 | 0.118638 | 0.054957 | 122 | 127 | 99 | 32.506 |
| AxxxxQ | CcchhH | 85.1 | 39.4 | 713.6 | 7.484263 | 6.6905e−14 | 0.119254 | 0.055247 | 104 | 108 | 83 | 18.21 |
| ETG | HHC | 74.9 | 34.7 | 331.4 | 7.207961 | 5.4644e−13 | 0.226011 | 0.104757 | 90 | 97 | 65 | 15.125 |
| SxxxxL | HhhhhC | 67.1 | 31.1 | 827.3 | 6.577482 | 4.4042e−11 | 0.081107 | 0.037604 | 81 | 85 | 67 | 22.607 |
| YxxxS | HhhhH | 214.8 | 99.6 | 1731.9 | 11.88306 | 1.3421e−32 | 0.124026 | 0.057535 | 218 | 259 | 183 | 47.88 |
| AxxQQ | HhhhH | 73.7 | 34.2 | 442.5 | 7.033591 | 1.8980e−12 | 0.166554 | 0.077271 | 81 | 92 | 68 | 13.121 |
| AxxxQ | HhhhC | 159.9 | 74.2 | 882.2 | 10.39559 | 2.4485e−25 | 0.181251 | 0.084109 | 186 | 203 | 140 | 22.602 |
| ExxxxQ | CcchhH | 78.9 | 36.6 | 518.6 | 7.24759 | 3.9788e−13 | 0.15214 | 0.070611 | 92 | 94 | 83 | 10.679 |
| DxxxR | HhhhH | 1593.6 | 739.8 | 6057.4 | 33.50368 | 4.1121e−246 | 0.263083 | 0.12213 | 1505 | 1906 | 1138 | 277.568 |
| AAxG | HHhC | 75.4 | 35 | 497.1 | 7.073599 | 1.4144e−12 | 0.15168 | 0.070477 | 89 | 100 | 78 | 15.642 |
| FxxE | ChhH | 60.5 | 28.1 | 344.2 | 6.366639 | 1.8254e−10 | 0.17577 | 0.081749 | 69 | 76 | 60 | 12.197 |
| DDxxR | HHHhH | 61.8 | 28.8 | 348.8 | 6.430871 | 1.1980e−10 | 0.177179 | 0.082463 | 63 | 72 | 53 | 15.074 |
| IxxxQ | HhhhH | 400.2 | 186.3 | 3042.8 | 16.17444 | 7.0518e−59 | 0.131524 | 0.061226 | 430 | 478 | 342 | 81.324 |
| TxxxxQ | CcchhH | 74.5 | 34.7 | 567.5 | 6.969533 | 2.9520e−12 | 0.131278 | 0.061168 | 84 | 93 | 70 | 13.997 |
| RxxxC | HhhhC | 172.6 | 80.5 | 831.2 | 10.80681 | 3.0229e−27 | 0.207652 | 0.096811 | 213 | 241 | 190 | 27.718 |
| GxxxxE | CcchhH | 400.5 | 186.8 | 2725.7 | 16.19978 | 4.6835e−59 | 0.146935 | 0.068536 | 454 | 524 | 390 | 76.391 |
| RAxG | HHcC | 86.6 | 40.4 | 412 | 7.653312 | 1.8592e−14 | 0.210194 | 0.09806 | 103 | 119 | 91 | 9.868 |
| LxxxxL | HhhhcC | 62.6 | 29.2 | 1199.2 | 6.256042 | 3.5831e−10 | 0.052201 | 0.024354 | 85 | 125 | 69 | 27.266 |
| YRD | CCC | 56.6 | 26.4 | 267.9 | 6.182857 | 5.9939e−10 | 0.211273 | 0.098638 | 54 | 66 | 36 | 25.66 |
| AxxxY | HhhcC | 58.6 | 27.4 | 444.2 | 6.164994 | 6.5438e−10 | 0.131923 | 0.061597 | 70 | 81 | 62 | 14.158 |
| YxGG | CcCC | 59 | 27.6 | 473.8 | 6.172162 | 6.2375e−10 | 0.124525 | 0.05816 | 67 | 68 | 43 | 24.891 |
| VxxxN | HhhhH | 437.6 | 204.7 | 2937.8 | 16.8822 | 5.6161e−64 | 0.148955 | 0.069662 | 457 | 507 | 342 | 94.476 |
| DxxxR | HhhhC | 205.1 | 96.1 | 824.3 | 11.82542 | 2.7483e−32 | 0.248817 | 0.116618 | 248 | 266 | 172 | 22.767 |
| ExxxW | HhhhH | 249 | 116.7 | 1634.9 | 12.70221 | 5.3036e−37 | 0.152303 | 0.071408 | 257 | 291 | 212 | 53.883 |
| HxN | ChH | 59.7 | 28 | 226.7 | 6.400861 | 1.4890e−10 | 0.263344 | 0.123483 | 63 | 72 | 55 | 13.091 |
| RxxxQ | HhhhH | 1065.6 | 500 | 4150.3 | 26.97253 | 2.9554e−160 | 0.256753 | 0.120469 | 1056 | 1312 | 832 | 186.326 |
| YxxxK | HhhhH | 681 | 320.1 | 3778.3 | 21.08821 | 9.4565e−99 | 0.18024 | 0.08471 | 729 | 824 | 583 | 174.419 |
| WxxxK | HhhhH | 195.9 | 92.1 | 1228.6 | 11.24863 | 2.1703e−29 | 0.15945 | 0.074949 | 212 | 249 | 175 | 30.575 |
| FxxxL | HhhhC | 61.4 | 28.9 | 908.1 | 6.148447 | 7.0691e−10 | 0.067614 | 0.031808 | 76 | 83 | 69 | 21.034 |
| AxxxxL | HhhhcC | 82.4 | 38.8 | 1305.4 | 7.106322 | 1.0716e−12 | 0.063122 | 0.029722 | 105 | 110 | 100 | 18.122 |
| TxVD | EeEE | 116.5 | 54.9 | 674.4 | 8.681155 | 3.6299e−18 | 0.172746 | 0.081358 | 128 | 48 | 12 | 12.641 |
| HxxxL | HhhhH | 353.1 | 166.4 | 3401.1 | 14.84586 | 6.6881e−50 | 0.103819 | 0.048913 | 371 | 453 | 320 | 106.756 |
| LxxxxE | CcchhH | 116 | 54.7 | 1020.9 | 8.516601 | 1.4929e−17 | 0.113625 | 0.053595 | 143 | 148 | 120 | 17.066 |
| LAxG | HHcC | 73.6 | 34.7 | 547.8 | 6.815209 | 8.6277e−12 | 0.134356 | 0.0634 | 87 | 87 | 80 | 4.742 |
| KxxGL | HhcCC | 60.1 | 28.4 | 463.9 | 6.148064 | 7.1894e−10 | 0.129554 | 0.061156 | 73 | 75 | 55 | 7.864 |
| DxxxxR | HhhccC | 74.8 | 35.3 | 488.9 | 6.897024 | 4.8780e−12 | 0.152997 | 0.072229 | 88 | 96 | 73 | 16.2 |
| DxR | HcC | 120.8 | 57.1 | 342.9 | 9.241439 | 2.3884e−20 | 0.352289 | 0.166413 | 120 | 144 | 93 | 21.057 |
| DxxxR | HhhcC | 150 | 70.9 | 559.5 | 10.05589 | 8.2324e−24 | 0.268097 | 0.126689 | 176 | 195 | 100 | 30.026 |
| QGQ | CCC | 91.8 | 43.4 | 358.4 | 7.828759 | 4.6739e−15 | 0.256138 | 0.121185 | 89 | 114 | 67 | 23.688 |
| KKxG | HHhC | 87.7 | 41.5 | 381.6 | 7.588969 | 3.0299e−14 | 0.229822 | 0.108834 | 96 | 104 | 80 | 14.791 |
| IxxxG | HhhhC | 159.3 | 75.4 | 1532.9 | 9.900532 | 3.7296e−23 | 0.103921 | 0.049218 | 182 | 218 | 162 | 32.855 |
| NxxL | HhhC | 88.6 | 42 | 577.8 | 7.473791 | 7.1427e−14 | 0.15334 | 0.072641 | 105 | 115 | 93 | 24.064 |
| AxxxxE | CcchhH | 148 | 70.1 | 1242.5 | 9.57374 | 9.3271e−22 | 0.119115 | 0.056438 | 182 | 205 | 160 | 23.239 |
| NxxxxK | CcchhH | 70.7 | 33.5 | 463.4 | 6.67288 | 2.3023e−11 | 0.152568 | 0.072292 | 80 | 93 | 57 | 15.959 |
| QxxxxK | HhhhcC | 80.9 | 38.3 | 526.8 | 7.138789 | 8.6346e−13 | 0.153569 | 0.072774 | 102 | 111 | 83 | 24.241 |
| FxxxM | HhhhH | 130.3 | 61.8 | 2397 | 8.831735 | 9.1511e−19 | 0.05436 | 0.025775 | 143 | 153 | 110 | 45.842 |
| IxxxH | HhhhH | 160.2 | 76 | 1637.9 | 9.889877 | 4.1336e−23 | 0.097808 | 0.046403 | 171 | 194 | 149 | 38.766 |
| RxxxxR | CcchhH | 64 | 30.4 | 468 | 6.305957 | 2.6131e−10 | 0.136752 | 0.064928 | 71 | 80 | 62 | 21.522 |
| SAxxA | HHhhH | 64.8 | 30.8 | 919.3 | 6.235618 | 4.0246e−10 | 0.070488 | 0.033488 | 74 | 86 | 66 | 15.231 |
| QxxxL | HhhhC | 85.3 | 40.7 | 488.9 | 7.293506 | 2.7653e−13 | 0.174473 | 0.083315 | 102 | 112 | 88 | 11.179 |
| FxxxE | HhhhH | 345.2 | 164.9 | 2494.4 | 14.52726 | 7.3232e−48 | 0.13839 | 0.066114 | 362 | 413 | 303 | 77.031 |
| AxxxxK | CchhhH | 65.6 | 31.3 | 553.9 | 6.29968 | 2.6877e−10 | 0.118433 | 0.056587 | 86 | 96 | 69 | 13.217 |
| SVT | EEE | 97.7 | 46.7 | 1097.2 | 7.630634 | 2.0807e−14 | 0.089045 | 0.042549 | 101 | 108 | 61 | 15.87 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| SxF | HcC | 65.2 | 31.2 | 400.3 | 6.340682 | 2.0860e−10 | 0.162878 | 0.077927 | 85 | 94 | 69 | 20.586 |
| NxxY | ChhH | 129.4 | 61.9 | 713 | 8.972069 | 2.6554e−19 | 0.181487 | 0.086858 | 137 | 153 | 113 | 32.324 |
| SIP | CCC | 122.5 | 58.7 | 674 | 8.717895 | 2.5843e−18 | 0.181751 | 0.087074 | 138 | 160 | 113 | 26.542 |
| AxxxQ | HhhhH | 1200.9 | 575.4 | 6408.2 | 27.32937 | 1.7264e−164 | 0.187401 | 0.089798 | 1143 | 1371 | 904 | 221.614 |
| PxxxN | HhhhH | 244.4 | 117.2 | 1114.8 | 12.42461 | 1.7671e−35 | 0.219232 | 0.105106 | 247 | 278 | 190 | 47.738 |
| PAxxA | HHhhH | 81.8 | 39.3 | 821.2 | 6.958559 | 3.0611e−12 | 0.09961 | 0.047803 | 97 | 107 | 91 | 17.091 |
| NxxM | ChhH | 80.1 | 38.5 | 489.7 | 6.994627 | 2.4124e−12 | 0.16357 | 0.078538 | 80 | 103 | 55 | 23.769 |
| ExxxR | HhhhC | 358.1 | 171.9 | 1395.4 | 15.16136 | 5.9193e−52 | 0.256629 | 0.123222 | 418 | 499 | 360 | 54.629 |
| PxxxR | HhhhH | 719.8 | 345.7 | 3048.4 | 21.37119 | 2.2826e−101 | 0.236124 | 0.113393 | 701 | 862 | 579 | 114.931 |
| KEG | HHC | 69.4 | 33.3 | 254.1 | 6.699047 | 1.9722e−11 | 0.273121 | 0.131224 | 76 | 88 | 50 | 6.688 |
| SxM | CcE | 75.8 | 36.4 | 475.7 | 6.789208 | 1.0209e−11 | 0.159344 | 0.076571 | 83 | 85 | 47 | 17.817 |
| ARxxA | HHhhH | 122.1 | 58.7 | 1454.9 | 8.445356 | 2.6748e−17 | 0.083923 | 0.040353 | 132 | 144 | 120 | 20.965 |
| LxxxxL | HhhccC | 97.7 | 47 | 2223.4 | 7.478582 | 6.5648e−14 | 0.043942 | 0.021131 | 125 | 146 | 109 | 37.694 |
| ExxxxS | HhhccC | 134.5 | 64.7 | 919.1 | 8.999618 | 2.0332e−19 | 0.146339 | 0.070398 | 156 | 177 | 133 | 21.65 |
| FxxxH | HhhhH | 105.8 | 50.9 | 1207.8 | 7.860939 | 3.3681e−15 | 0.087597 | 0.042149 | 126 | 136 | 103 | 37.372 |
| GxSxE | CcChH | 87.9 | 42.3 | 619 | 7.264315 | 3.3686e−13 | 0.142003 | 0.068333 | 101 | 107 | 86 | 23.805 |
| DxxRS | HhhHH | 61.7 | 29.7 | 350.8 | 6.13944 | 7.5388e−10 | 0.175884 | 0.084643 | 77 | 80 | 61 | 7.371 |
| GSV | CCE | 68.4 | 32.9 | 455.6 | 6.418609 | 1.2407e−10 | 0.150132 | 0.072268 | 78 | 84 | 58 | 14.803 |
| ExxxxR | HhhccC | 116.1 | 55.9 | 742.2 | 8.375368 | 4.9567e−17 | 0.156427 | 0.075303 | 145 | 165 | 130 | 26.948 |
| FxxxG | HhhhC | 124.9 | 60.2 | 1209.9 | 8.555379 | 1.0397e−17 | 0.103232 | 0.049752 | 146 | 164 | 116 | 26.139 |
| QxxxL | HhhhH | 851 | 410.1 | 7080.9 | 22.42827 | 1.8468e−111 | 0.120182 | 0.057922 | 853 | 962 | 660 | 154.311 |
| QxxxY | HhhhH | 271.3 | 130.8 | 1885.2 | 12.73119 | 3.5409e−37 | 0.14391 | 0.069396 | 285 | 331 | 221 | 45.473 |
| LxF | CcE | 75 | 36.2 | 816.4 | 6.588127 | 3.9326e−11 | 0.091867 | 0.044382 | 79 | 80 | 59 | 18.526 |
| YxxxE | CchhH | 112.3 | 54.3 | 687 | 8.211157 | 1.9695e−16 | 0.163464 | 0.078974 | 134 | 152 | 114 | 35.048 |
| ExxxxK | CchhhH | 94.6 | 45.7 | 621.2 | 7.513633 | 5.1579e−14 | 0.152286 | 0.073579 | 114 | 124 | 91 | 25.02 |
| QxxxF | HhhhH | 258.4 | 125 | 2416.8 | 12.25568 | 1.3787e−34 | 0.106918 | 0.051712 | 267 | 292 | 198 | 57.252 |
| MxxxQ | CchhH | 65.8 | 31.8 | 417.5 | 6.263424 | 3.3882e−10 | 0.157605 | 0.07625 | 76 | 87 | 71 | 5.183 |
| HxxxD | HhhhH | 206.8 | 100.1 | 1013.9 | 11.22807 | 2.6894e−29 | 0.203965 | 0.098763 | 207 | 252 | 176 | 38.725 |
| KxGxT | CcCcC | 72 | 34.9 | 523.7 | 6.508995 | 6.7535e−11 | 0.137483 | 0.066578 | 79 | 71 | 44 | 14.708 |
| PxxxM | HhhhH | 89.5 | 43.3 | 757.8 | 7.2189 | 4.6432e−13 | 0.118105 | 0.057205 | 102 | 106 | 84 | 25.723 |
| TxY | ChH | 85.9 | 41.6 | 440.4 | 7.210357 | 5.0580e−13 | 0.19505 | 0.09453 | 83 | 95 | 60 | 11.836 |
| RxxxN | HhhhH | 653.6 | 316.9 | 2892.5 | 20.04073 | 2.2101e−89 | 0.225964 | 0.109571 | 638 | 758 | 493 | 166.223 |
| TxTG | CcCC | 114.1 | 55.4 | 731.8 | 8.204551 | 2.0652e−16 | 0.155917 | 0.075694 | 118 | 130 | 77 | 56.478 |
| NxxH | HhhH | 180.4 | 87.6 | 891.3 | 10.44351 | 1.4170e−25 | 0.202401 | 0.098269 | 180 | 217 | 148 | 36.561 |
| YxxxE | HhhhH | 396.6 | 192.7 | 2422.9 | 15.32313 | 4.7702e−53 | 0.163771 | 0.079539 | 427 | 499 | 343 | 75.821 |
| VxxxQ | CchhH | 116.7 | 56.7 | 787.6 | 8.275504 | 1.1380e−16 | 0.148172 | 0.071966 | 132 | 144 | 112 | 38.882 |
| RExxL | HHhhH | 112.2 | 54.5 | 836.4 | 8.083483 | 5.5774e−16 | 0.134146 | 0.065161 | 131 | 138 | 113 | 26.81 |
| NxxxY | HhhhH | 187.1 | 90.9 | 1394.3 | 10.43545 | 1.5096e−25 | 0.134189 | 0.065196 | 196 | 234 | 161 | 56.034 |
| EAxxxE | HHhhhH | 84.2 | 40.9 | 815.1 | 6.93732 | 3.5127e−12 | 0.1033 | 0.050228 | 89 | 93 | 82 | 20.70 |
| AxF | CcE | 119.3 | 58 | 980.5 | 8.293706 | 9.6758e−17 | 0.121673 | 0.059176 | 126 | 137 | 89 | 19.508 |
| PExxR | HHhhH | 110.7 | 53.8 | 655.7 | 8.086699 | 5.4810e−16 | 0.168827 | 0.082123 | 126 | 141 | 107 | 14.452 |
| MxxxY | HhhhH | 108.2 | 52.7 | 1431.8 | 7.795767 | 5.5677e−15 | 0.075569 | 0.036787 | 109 | 122 | 88 | 40.104 |
| ERxG | HHhH | 65.2 | 31.7 | 305.7 | 6.27148 | 3.2513e−10 | 0.213281 | 0.103854 | 76 | 76 | 70 | 10.267 |
| TxxxxN | ChhhhH | 72.2 | 35.2 | 571.7 | 6.444471 | 1.0257e−10 | 0.12629 | 0.061525 | 94 | 101 | 81 | 15.818 |
| HxxN | HhhH | 260.9 | 127.1 | 1176.7 | 12.56098 | 3.1284e−36 | 0.221722 | 0.108046 | 232 | 287 | 167 | 78.115 |
| SxxxN | ChhhH | 71.4 | 34.8 | 551.2 | 6.406584 | 1.3160e−10 | 0.129536 | 0.063158 | 82 | 88 | 59 | 16.96 |
| RxxxE | HhhhH | 2928.1 | 1427.8 | 11214.8 | 42.50305 | 0.0000e+00 | 0.261092 | 0.127313 | 2601 | 3500 | 2041 | 525.598 |
| NxxxF | HhhhH | 155.5 | 75.8 | 1607.2 | 9.369422 | 6.3552e−21 | 0.096752 | 0.047193 | 161 | 180 | 140 | 39.768 |
| NxxxS | HhhhH | 514.3 | 251.1 | 2512.2 | 17.50681 | 1.1392e−68 | 0.204721 | 0.099956 | 526 | 601 | 395 | 70.614 |
| ExxRQ | HhhHH | 149.6 | 73.1 | 886.5 | 9.344841 | 8.1784e−21 | 0.168754 | 0.082435 | 158 | 177 | 141 | 21.975 |
| NxF | HhC | 72.6 | 35.5 | 446 | 6.491726 | 7.5556e−11 | 0.16278 | 0.079585 | 82 | 87 | 71 | 13.599 |
| SxxxD | HhhhC | 98.8 | 48.3 | 457.9 | 7.675582 | 1.4860e−14 | 0.215768 | 0.105553 | 118 | 132 | 90 | 12.446 |
| VNG | ECC | 97.3 | 47.6 | 641 | 7.485467 | 6.3078e−14 | 0.151794 | 0.07427 | 111 | 127 | 83 | 24.925 |
| HxxxT | HhhhH | 192.6 | 94.3 | 1244.4 | 10.53318 | 5.3588e−26 | 0.154773 | 0.075761 | 192 | 227 | 168 | 35.961 |
| FxxxD | CchhH | 109.6 | 53.7 | 851.1 | 7.887565 | 2.7037e−15 | 0.128775 | 0.063058 | 116 | 133 | 90 | 24.115 |
| NxxxN | HhhhH | 411.8 | 201.8 | 1933.5 | 15.62583 | 4.3487e−55 | 0.212962 | 0.104345 | 422 | 490 | 354 | 80.053 |
| ExxLS | HhhHH | 102.2 | 50.1 | 839.3 | 7.584261 | 2.9242e−14 | 0.121768 | 0.059728 | 112 | 129 | 86 | 14.243 |
| YxA | EeC | 123.8 | 60.8 | 897.4 | 8.374344 | 4.8699e−17 | 0.137954 | 0.067715 | 132 | 137 | 87 | 28.11 |
| GxxxxK | CcchhH | 153.6 | 75.4 | 1023 | 9.34895 | 7.7771e−21 | 0.150147 | 0.07375 | 174 | 189 | 148 | 33.669 |
| LSE | CCH | 67.5 | 33.2 | 383.7 | 6.23619 | 3.9711e−10 | 0.175919 | 0.086443 | 73 | 80 | 62 | 10.044 |
| KVxK | EEeE | 129 | 63.4 | 665.5 | 8.662445 | 4.1119e−18 | 0.193839 | 0.09526 | 148 | 68 | 22 | 13.372 |
| AxxER | HHhHH | 160.2 | 78.8 | 960 | 9.579453 | 8.6052e−22 | 0.166875 | 0.082033 | 183 | 187 | 143 | 28.163 |
| LxxxQ | HhhhH | 838.5 | 412.3 | 6031.4 | 21.74665 | 6.4761e−105 | 0.139022 | 0.068358 | 850 | 997 | 687 | 139.608 |
| NxxxG | HhhhC | 114.1 | 56.1 | 662.4 | 8.090558 | 5.2533e−16 | 0.172252 | 0.084717 | 131 | 151 | 116 | 19.267 |
| DExxR | HHhhH | 151.9 | 74.7 | 886.6 | 9.330064 | 9.3406e−21 | 0.171329 | 0.08428 | 178 | 190 | 132 | 23.764 |
| HxS | ChH | 120.6 | 59.3 | 487.3 | 8.485009 | 1.9520e−17 | 0.247486 | 0.121783 | 122 | 142 | 94 | 47.563 |
| RxxxxD | HhhccC | 174.6 | 85.9 | 1073.5 | 9.970399 | 1.8063e−23 | 0.162646 | 0.080061 | 201 | 218 | 156 | 37.795 |
| NxA | ChH | 528.3 | 260.2 | 2030.4 | 17.79765 | 6.6617e−71 | 0.260191 | 0.128165 | 527 | 651 | 418 | 107.697 |
| RxxxM | HhhhH | 316.3 | 155.8 | 2095.9 | 13.3639 | 8.5903e−41 | 0.150914 | 0.074339 | 338 | 384 | 276 | 66.921 |
| EAxG | HHcC | 82.7 | 40.7 | 436.1 | 6.903283 | 4.5200e−12 | 0.189635 | 0.093429 | 102 | 118 | 89 | 12.2 |
| QxF | EeE | 222 | 109.4 | 1489.4 | 11.18519 | 4.2124e−29 | 0.149053 | 0.073447 | 230 | 258 | 153 | 59.238 |
| NxY | ChH | 107.4 | 52.9 | 534.1 | 7.884635 | 2.8091e−15 | 0.201086 | 0.099131 | 114 | 124 | 96 | 17.744 |
| WxxxS | HhhhH | 82.7 | 40.8 | 958.5 | 6.709178 | 1.6880e−11 | 0.086281 | 0.042544 | 93 | 111 | 71 | 32.016 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| NxxD | HhhC | 65.7 | 32.5 | 306.6 | 6.16967 | 6.1279e−10 | 0.214286 | 0.105875 | 73 | 74 | 52 | 10.337 |
| AxxxQ | CchhH | 130.5 | 64.5 | 770.7 | 8.587977 | 7.7782e−18 | 0.169327 | 0.08367 | 142 | 151 | 108 | 16.149 |
| PxxQ | ChhH | 241 | 119.4 | 891.4 | 11.96006 | 5.1935e−33 | 0.270361 | 0.13393 | 247 | 296 | 186 | 41.075 |
| SxA | ChH | 850.1 | 421.1 | 3347.3 | 22.35703 | 9.2441e−111 | 0.253966 | 0.125812 | 844 | 989 | 615 | 158.146 |
| AAxxR | HHHhH | 129.8 | 64.3 | 1242.9 | 8.387023 | 4.2884e−17 | 0.104433 | 0.051739 | 151 | 173 | 118 | 22.819 |
| TxA | ChH | 715.6 | 354.6 | 2588.8 | 20.63903 | 1.1060e−94 | 0.276422 | 0.13696 | 686 | 858 | 491 | 130.016 |
| LPxE | CChH | 68.7 | 34 | 555.4 | 6.130691 | 7.5993e−10 | 0.123695 | 0.061295 | 83 | 92 | 77 | 8.37 |
| QxxxE | HhhhC | 174.5 | 86.5 | 667.8 | 10.13754 | 3.3887e−24 | 0.261306 | 0.129565 | 221 | 243 | 193 | 32.093 |
| SxxxxR | ChhhhH | 261 | 129.5 | 1853.7 | 11.98243 | 3.8015e−33 | 0.140799 | 0.069857 | 294 | 311 | 234 | 48.458 |
| QxxxM | HhhhH | 197.5 | 98 | 1607.1 | 10.37229 | 2.8562e−25 | 0.122892 | 0.060979 | 210 | 223 | 171 | 43.25 |
| FxA | CcH | 93.2 | 46.2 | 622.7 | 7.175335 | 6.2867e−13 | 0.149671 | 0.074273 | 106 | 100 | 69 | 24.295 |
| RRxxA | HHHhH | 86.1 | 42.7 | 559.3 | 6.903535 | 4.4287e−12 | 0.153942 | 0.0764 | 93 | 106 | 88 | 18.855 |
| AAG | HCC | 163.7 | 81.2 | 702.7 | 9.726602 | 2.0695e−22 | 0.232959 | 0.115625 | 186 | 217 | 165 | 35.286 |
| RxxxH | HhhhH | 331.8 | 164.7 | 1574.4 | 13.75929 | 3.9545e−43 | 0.210747 | 0.104616 | 343 | 393 | 284 | 91.04 |
| KAxG | HHcC | 86.7 | 43.1 | 434.8 | 7.007685 | 2.1431e−12 | 0.199402 | 0.099021 | 105 | 123 | 93 | 12.619 |
| SxxG | EccE | 85.4 | 42.4 | 515.1 | 6.890972 | 4.8521e−12 | 0.165793 | 0.082335 | 93 | 101 | 56 | 16.833 |
| NxxxL | HhhhH | 450.7 | 223.9 | 4154.2 | 15.57809 | 8.7727e−55 | 0.108493 | 0.053909 | 464 | 574 | 354 | 121.326 |
| SxxxQ | HhhhH | 680.2 | 338 | 3360 | 19.62634 | 8.0947e−86 | 0.20244 | 0.100596 | 708 | 826 | 541 | 113.599 |
| VxxxE | CchhH | 245.6 | 122.1 | 1615.1 | 11.61904 | 2.8573e−31 | 0.152065 | 0.075624 | 271 | 323 | 228 | 40.287 |
| YxxxD | HhhhH | 157.6 | 78.4 | 997.2 | 9.32088 | 1.0028e−20 | 0.158043 | 0.078606 | 154 | 171 | 131 | 51.967 |
| TFP | CCC | 67.2 | 33.4 | 373.1 | 6.119638 | 8.2482e−10 | 0.180113 | 0.089618 | 71 | 71 | 51 | 18.232 |
| DxxxW | HhhhH | 115.7 | 57.6 | 860.6 | 7.929366 | 1.9031e−15 | 0.134441 | 0.066906 | 129 | 142 | 113 | 26.428 |
| PxN | ChH | 192.2 | 95.7 | 703.2 | 10.61399 | 2.3079e−26 | 0.273322 | 0.136083 | 201 | 242 | 139 | 32.479 |
| TxxxG | HhhhC | 132.9 | 66.2 | 909 | 8.507609 | 1.5359e−17 | 0.146205 | 0.072863 | 160 | 179 | 129 | 28.082 |
| MxxxR | HhhhH | 285.5 | 142.3 | 1901.9 | 12.48189 | 8.0946e−36 | 0.150113 | 0.074814 | 303 | 360 | 254 | 58.722 |
| WxN | EeC | 79.3 | 39.5 | 468.5 | 6.61109 | 3.3332e−11 | 0.169264 | 0.08437 | 90 | 103 | 58 | 28.048 |
| VxxxT | CchhH | 99.3 | 49.5 | 842.9 | 7.295684 | 2.5533e−13 | 0.117808 | 0.058726 | 111 | 125 | 95 | 29.562 |
| ExxxxE | CcchhH | 191.6 | 95.5 | 1299.3 | 10.21315 | 1.4953e−24 | 0.147464 | 0.073517 | 221 | 231 | 184 | 34.126 |
| AxxRA | HhhHH | 165.8 | 82.7 | 1804.6 | 9.359131 | 6.8374e−21 | 0.091876 | 0.045813 | 181 | 196 | 152 | 34.61 |
| DxxxxP | HhhccC | 81.2 | 40.5 | 566.5 | 6.632996 | 2.8486e−11 | 0.143336 | 0.071521 | 99 | 106 | 76 | 12 |
| YxxxV | HhhhH | 261.5 | 130.5 | 3516 | 11.68707 | 1.2533e−31 | 0.074374 | 0.037115 | 270 | 307 | 224 | 73.847 |
| ExxxxR | HhcccC | 91.4 | 45.6 | 570.5 | 7.067226 | 1.3740e−12 | 0.16021 | 0.079958 | 107 | 110 | 92 | 25.338 |
| AxxQR | HhhHH | 73 | 36.5 | 485.4 | 6.292274 | 2.7145e−10 | 0.150391 | 0.075114 | 83 | 97 | 75 | 12.836 |
| IxxxD | HhhhH | 254.3 | 127.1 | 1867.9 | 11.69002 | 1.2299e−31 | 0.136142 | 0.068034 | 254 | 301 | 218 | 48.416 |
| NxxxxD | CcchhH | 109.2 | 54.6 | 880.8 | 7.633463 | 1.9605e−14 | 0.123978 | 0.061967 | 124 | 132 | 101 | 24.306 |
| WxxxL | HhhhH | 145.8 | 72.9 | 2398.9 | 8.665128 | 3.7936e−18 | 0.060778 | 0.030403 | 161 | 181 | 139 | 25.481 |
| WxxE | HhhH | 321.8 | 161.2 | 1855.3 | 13.24235 | 4.3211e−40 | 0.173449 | 0.086864 | 333 | 381 | 277 | 57.781 |
| FPG | CCC | 138.7 | 69.5 | 857.5 | 8.66519 | 3.8961e−18 | 0.161749 | 0.08101 | 145 | 154 | 109 | 30.1 |
| YH | EC | 69.6 | 34.9 | 354.8 | 6.193445 | 5.1633e−10 | 0.196167 | 0.098282 | 67 | 80 | 49 | 14.582 |
| DxxxxE | CcchhH | 154.5 | 77.4 | 1117.3 | 9.079327 | 9.3679e−20 | 0.13828 | 0.069298 | 177 | 204 | 160 | 36.074 |
| QxxR | ChhH | 74.6 | 37.4 | 275.8 | 6.539894 | 5.5204e−11 | 0.270486 | 0.135645 | 82 | 89 | 58 | 27.364 |
| LGL | HCC | 74.7 | 37.5 | 580.4 | 6.283761 | 2.8353e−10 | 0.128704 | 0.064592 | 89 | 91 | 82 | 13.4 |
| PGY | CCC | 82.9 | 41.6 | 425.5 | 6.738554 | 1.3978e−11 | 0.19483 | 0.097795 | 88 | 98 | 77 | 17.918 |
| HxxxI | HhhhH | 127.4 | 64 | 1572.2 | 8.093262 | 4.8957e−16 | 0.081033 | 0.040701 | 142 | 153 | 122 | 38.735 |
| AExxQ | HHhhH | 100.1 | 50.3 | 642.7 | 7.316766 | 2.1891e−13 | 0.155749 | 0.078242 | 106 | 116 | 92 | 17.982 |
| ExxAS | HhhHH | 78.3 | 39.4 | 631.6 | 6.411106 | 1.2354e−10 | 0.123971 | 0.062309 | 84 | 105 | 70 | 21.553 |
| DxxRQ | HhhhH | 84.9 | 42.7 | 678.29 | 6.78259 | 1.0263e−11 | 0.185088 | 0.093078 | 95 | 101 | 77 | 17.416 |
| ExxxF | HhhcC | 77.4 | 38.9 | 528.7 | 6.406402 | 1.2815e−10 | 0.146397 | 0.07363 | 94 | 106 | 86 | 11.703 |
| AExG | HHhC | 70.3 | 35.4 | 410.4 | 6.143817 | 6.9830e−10 | 0.171296 | 0.086186 | 85 | 102 | 80 | 15.625 |
| ASG | HCC | 79.4 | 40 | 365.1 | 6.610071 | 3.3716e−11 | 0.217475 | 0.109465 | 82 | 89 | 67 | 27.147 |
| DAA | CHH | 69.4 | 34.9 | 328.4 | 6.1475e−10 | 6.1475e−10 | 0.211328 | 0.10641 | 74 | 93 | 54 | 9.497 |
| KxxxxN | HhhccC | 132.1 | 66.5 | 806.8 | 8.389233 | 4.2077e−17 | 0.163733 | 0.082483 | 155 | 171 | 124 | 23.736 |
| QxxxS | HhhhH | 623.3 | 314 | 3007.9 | 18.44224 | 5.2220e−76 | 0.207221 | 0.104399 | 641 | 765 | 493 | 120.461 |
| IxxxE | HhhhH | 652.2 | 328.6 | 4866.2 | 18.48686 | 2.2361e−76 | 0.134027 | 0.067526 | 672 | 799 | 570 | 137.019 |
| QxxxT | HhhhH | 555.2 | 279.9 | 2775.6 | 17.35473 | 1.5715e−67 | 0.200029 | 0.100838 | 576 | 659 | 427 | 105.928 |
| FxxxL | HhhhH | 426.4 | 215.1 | 9230.4 | 14.57674 | 3.2704e−48 | 0.046195 | 0.023305 | 463 | 470 | 340 | 97.989 |
| VxxxxL | CchhhH | 80.9 | 40.8 | 2037.1 | 6.338101 | 1.9368e−10 | 0.039713 | 0.020036 | 101 | 106 | 82 | 21.898 |
| QxxR | HhhC | 128.7 | 65 | 477.4 | 8.509002 | 1.5563e−17 | 0.269585 | 0.136064 | 137 | 156 | 112 | 23.243 |
| TxxxY | HhhhH | 213.6 | 107.8 | 2022 | 10.47044 | 9.9480e−26 | 0.105638 | 0.053322 | 239 | 260 | 177 | 84.626 |
| NF | HC | 110.1 | 55.6 | 503.5 | 7.750356 | 8.0006e−15 | 0.218669 | 0.110418 | 112 | 141 | 92 | 15.526 |
| DH | HC | 131.5 | 66.4 | 320.4 | 8.971856 | 2.7193e−19 | 0.410424 | 0.207256 | 129 | 157 | 111 | 22.973 |
| QxxER | HhhHH | 70.7 | 35.7 | 399.7 | 6.137637 | 7.2446e−10 | 0.176883 | 0.089324 | 71 | 79 | 64 | 15.047 |
| DAG | HCC | 85.4 | 43.1 | 354.4 | 6.866307 | 5.8013e−12 | 0.240971 | 0.121717 | 98 | 115 | 78 | 10.867 |
| QQxxA | HHhhH | 78 | 39.4 | 558.3 | 6.368381 | 1.6309e−10 | 0.13971 | 0.070648 | 86 | 99 | 69 | 9.346 |
| LxxxT | CchhH | 95.4 | 48.3 | 871.5 | 6.983018 | 2.4411e−12 | 0.109466 | 0.055369 | 108 | 117 | 96 | 28.085 |
| QAxxD | HHhhH | 99.7 | 50.5 | 702.9 | 7.189078 | 5.5537e−13 | 0.141841 | 0.071827 | 112 | 122 | 98 | 13.289 |
| KxxxxR | CchhhH | 83.4 | 42.2 | 572.5 | 6.58186 | 3.9651e−11 | 0.145677 | 0.073771 | 99 | 107 | 77 | 16.931 |
| SxEQ | ChhH | 106.6 | 54 | 926.8 | 7.379054 | 1.3464e−13 | 0.115019 | 0.058249 | 114 | 129 | 86 | 22.79 |
| QxW | EeE | 94.4 | 47.9 | 664.8 | 6.985402 | 2.4170e−12 | 0.141998 | 0.071977 | 94 | 109 | 66 | 30.429 |
| RxxxE | HhhhC | 308.8 | 156.5 | 1155 | 13.08793 | 3.3953e−39 | 0.267359 | 0.135538 | 389 | 450 | 331 | 52.801 |
| NxxL | ChhH | 281.7 | 142.8 | 1993.4 | 12.05842 | 1.4819e−33 | 0.141316 | 0.071657 | 301 | 341 | 257 | 59.804 |
| IxxxR | HhhhH | 603.5 | 306 | 4707.3 | 17.58507 | 2.6989e−69 | 0.128205 | 0.065013 | 644 | 748 | 514 | 134.938 |
| SxxxG | HhhhC | 189.6 | 96.2 | 1456 | 9.861034 | 5.1865e−23 | 0.13022 | 0.066039 | 212 | 252 | 180 | 40.425 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| ExxxQ | HhhhH | 1903.9 | 965.9 | 7773.1 | 32.25062 | 3.0026e−228 | 0.244934 | 0.124264 | 1811 | 2315 | 1395 | 311.531 |
| QxP | EeC | 114.4 | 58 | 719.8 | 7.713629 | 1.0432e−14 | 0.158933 | 0.080647 | 133 | 120 | 52 | 15.896 |
| SxxM | ChhH | 89.2 | 45.3 | 602.1 | 6.789937 | 9.5554e−12 | 0.148148 | 0.075183 | 94 | 105 | 82 | 20 |
| SxxxL | HhhcC | 74.1 | 37.6 | 549.3 | 6.158948 | 6.2187e−10 | 0.134899 | 0.068513 | 89 | 100 | 81 | 21.314 |
| NPT | CCC | 103 | 52.3 | 577.1 | 7.347429 | 1.7329e−13 | 0.178479 | 0.090661 | 107 | 117 | 61 | 12.992 |
| GxxQ | ChhH | 163.5 | 83.1 | 829.6 | 9.303796 | 1.1657e−20 | 0.197083 | 0.100124 | 173 | 204 | 138 | 30.525 |
| NxxN | ChhH | 243.7 | 123.8 | 1030.3 | 11.48567 | 1.3538e−30 | 0.236533 | 0.120178 | 252 | 299 | 180 | 56.967 |
| RxxxxP | HhhccC | 119.3 | 60.6 | 837.7 | 7.825423 | 4.2887e−15 | 0.142414 | 0.072363 | 156 | 170 | 129 | 28.616 |
| SxQ | ChH | 428.7 | 217.8 | 1547 | 15.41239 | 1.1886e−53 | 0.277117 | 0.140817 | 430 | 513 | 345 | 65.108 |
| ExLG | HhHC | 117.4 | 59.7 | 783.8 | 7.773841 | 6.4656e−15 | 0.149783 | 0.076139 | 147 | 151 | 126 | 22.062 |
| YxxxT | HhhhH | 198.7 | 101.1 | 1762.5 | 10.00453 | 1.2198e−23 | 0.112738 | 0.057336 | 216 | 230 | 159 | 40.009 |
| SEA | CHH | 80.7 | 41.1 | 343 | 6.595633 | 3.6965e−11 | 0.235277 | 0.119681 | 91 | 100 | 75 | 13.436 |
| SxxxR | HhhhH | 800.7 | 407.6 | 4098.8 | 20.52142 | 1.1851e−93 | 0.19535 | 0.099432 | 814 | 960 | 651 | 163.053 |
| LxxxN | HhhhC | 162.3 | 82.7 | 1288.9 | 9.05616 | 1.1357e−19 | 0.125921 | 0.064126 | 188 | 203 | 159 | 31.187 |
| LxxxR | HhhhH | 1256.2 | 640.3 | 9084.4 | 25.24464 | 1.0887e−140 | 0.138281 | 0.070486 | 1290 | 1519 | 1082 | 248.703 |
| ExxR | HhhH | 4348.2 | 2217.2 | 15346 | 48.92995 | 0.0000e+00 | 0.283344 | 0.144479 | 3640 | 5115 | 2655 | 709.592 |
| RxxxF | HhhhH | 272.8 | 139.1 | 2338.6 | 11.68438 | 1.2799e−31 | 0.116651 | 0.059496 | 289 | 325 | 244 | 64.798 |
| ALG | HHC | 97.2 | 49.6 | 629.4 | 7.045039 | 1.5728e−12 | 0.154433 | 0.078782 | 124 | 136 | 105 | 19.697 |
| SxDE | ChHH | 97.5 | 49.7 | 519.2 | 7.121477 | 9.1460e−13 | 0.187789 | 0.095803 | 99 | 113 | 88 | 16.819 |
| TxxxN | HhhhC | 105 | 53.6 | 580 | 7.371169 | 1.4445e−13 | 0.181034 | 0.0924 | 127 | 141 | 104 | 12.344 |
| ExxxY | HhhhH | 629.3 | 321.2 | 3734.6 | 17.97894 | 2.4098e−72 | 0.168505 | 0.086016 | 649 | 764 | 489 | 132.972 |
| RxxxxN | HhcccC | 81 | 41.4 | 530.9 | 6.420158 | 1.1549e−10 | 0.152571 | 0.077895 | 93 | 104 | 61 | 6.844 |
| DxxxxQ | ChhhhH | 152.3 | 77.8 | 1117.8 | 8.75111 | 1.7751e−18 | 0.13625 | 0.06963 | 173 | 184 | 159 | 30.431 |
| LxxxY | HhhhH | 436.4 | 223 | 6456.4 | 14.54017 | 5.5425e−48 | 0.067592 | 0.034545 | 424 | 494 | 322 | 142.511 |
| QxxC | HhhH | 102.3 | 52.3 | 908 | 7.121624 | 8.9199e−13 | 0.112665 | 0.057601 | 111 | 114 | 75 | 26.926 |
| PxS | EhH | 130.1 | 66.5 | 449.4 | 8.442109 | 2.7448e−17 | 0.289497 | 0.148061 | 139 | 154 | 54 | 29.149 |
| SxxE | EhhH | 86.7 | 44.4 | 455.6 | 6.691661 | 1.8876e−11 | 0.190299 | 0.097361 | 90 | 102 | 80 | 12.275 |
| WxxQ | HhhH | 174.6 | 89.4 | 1173.3 | 9.380752 | 5.5115e−21 | 0.148811 | 0.076165 | 198 | 232 | 142 | 42.633 |
| TxxxR | HhhhH | 665.8 | 341.1 | 3439.7 | 18.52247 | 1.1550e−76 | 0.193563 | 0.099169 | 684 | 772 | 543 | 132.037 |
| SxxQ | ChhH | 506 | 259.3 | 2528 | 16.17084 | 6.8893e−59 | 0.200183 | 0.102577 | 508 | 612 | 382 | 71.886 |
| QExxA | HHhhH | 89.4 | 45.8 | 602.2 | 6.698367 | 1.7776e−11 | 0.148456 | 0.076085 | 101 | 107 | 86 | 12.412 |
| NxxxI | HhhhH | 188 | 96.5 | 2023 | 9.548308 | 1.0890e−21 | 0.092931 | 0.04769 | 181 | 216 | 156 | 46.585 |
| AxxDA | HhhHH | 99.9 | 51.3 | 1121.1 | 6.945769 | 3.1146e−12 | 0.089109 | 0.045761 | 113 | 123 | 106 | 17.081 |
| RxxxxE | HhcccC | 98.1 | 50.4 | 624.8 | 7.004826 | 2.0838e−12 | 0.15701 | 0.080687 | 118 | 132 | 108 | 16.112 |
| VxxxQ | HhhhH | 449.5 | 231 | 3342.8 | 14.89745 | 2.8501e−50 | 0.134468 | 0.069112 | 470 | 537 | 380 | 90.195 |
| HxxxM | HhhhH | 95.5 | 49.1 | 883.3 | 6.814365 | 7.8684e−12 | 0.108117 | 0.055585 | 103 | 107 | 81 | 23.829 |
| KYG | HHC | 97.9 | 50.3 | 426.2 | 7.139373 | 8.0699e−13 | 0.229704 | 0.118099 | 112 | 125 | 83 | 16.329 |
| EExG | HHhC | 98.4 | 50.6 | 520 | 7.065914 | 1.3554e−12 | 0.189231 | 0.097369 | 121 | 145 | 109 | 15.932 |
| NxQ | EcC | 117.5 | 60.5 | 485.7 | 7.832707 | 4.1145e−15 | 0.241919 | 0.124557 | 122 | 138 | 80 | 24.775 |
| RxxxD | HhhhH | 1124.8 | 579.6 | 4662.5 | 24.19752 | 2.0224e−129 | 0.241244 | 0.12432 | 1106 | 1350 | 903 | 210.134 |
| DxY | ChH | 151.5 | 78.1 | 697.2 | 8.818579 | 9.8907e−19 | 0.217298 | 0.11198 | 158 | 182 | 134 | 35.046 |
| ExxxF | HhccC | 104.5 | 53.9 | 703.6 | 7.170991 | 6.2323e−13 | 0.148522 | 0.076616 | 127 | 124 | 95 | 22.902 |
| PxxxE | CchhH | 317.3 | 163.7 | 1905.6 | 12.55449 | 3.1445e−36 | 0.166509 | 0.085914 | 345 | 384 | 267 | 61.567 |
| VxxxxE | CcchhH | 89.2 | 46 | 874.3 | 6.538549 | 5.1382e−11 | 0.102024 | 0.052642 | 119 | 127 | 113 | 27.383 |
| AQxxA | HHhhH | 97 | 50.1 | 1116.6 | 6.788691 | 9.3146e−12 | 0.086871 | 0.044831 | 115 | 134 | 101 | 19.916 |
| EAxxA | HHhhH | 202.1 | 104.3 | 2020.6 | 9.828707 | 6.9670e−23 | 0.10002 | 0.051634 | 234 | 262 | 217 | 31.039 |
| MxxxD | HhhhH | 153.4 | 79.2 | 1113.4 | 8.646793 | 4.4054e−18 | 0.137772 | 0.071156 | 179 | 190 | 141 | 37.128 |
| NxxxT | HhhhH | 370.4 | 191.4 | 2062 | 13.58795 | 3.9615e−42 | 0.179631 | 0.092806 | 377 | 434 | 297 | 56.147 |
| AGP | CCC | 129.7 | 67 | 642.9 | 8.089518 | 5.0769e−16 | 0.201742 | 0.104248 | 135 | 152 | 92 | 46.054 |
| RxxxE | CchhH | 240.9 | 124.5 | 1092.3 | 11.07871 | 1.3526e−28 | 0.220544 | 0.114007 | 256 | 294 | 223 | 48.713 |
| QAG | HCC | 72.9 | 37.7 | 291.4 | 6.147215 | 6.8091e−10 | 0.250172 | 0.129331 | 81 | 87 | 67 | 10.542 |
| YxxxG | HhhhC | 130.4 | 67.4 | 1073.5 | 7.92034 | 1.9602e−15 | 0.121461 | 0.062812 | 146 | 170 | 128 | 22.109 |
| RxxxI | HhhcC | 83.8 | 43.4 | 545.9 | 6.399601 | 1.3039e−10 | 0.153508 | 0.079439 | 100 | 95 | 76 | 12.163 |
| HH | HC | 98.4 | 50.9 | 263.6 | 7.406467 | 1.1640e−13 | 0.373293 | 0.193191 | 111 | 122 | 97 | 18.524 |
| RRxxE | HHhhH | 190.5 | 98.6 | 1055.7 | 9.717855 | 2.1236e−22 | 0.180449 | 0.093412 | 196 | 232 | 157 | 51.463 |
| IxxxR | HhhhC | 78 | 40.4 | 663.7 | 6.108153 | 8.3534e−10 | 0.117523 | 0.060846 | 92 | 93 | 74 | 14.325 |
| AxxxR | HhhhH | 1716.6 | 888.9 | 9975.9 | 29.09357 | 3.6109e−186 | 0.172075 | 0.089093 | 1654 | 2079 | 1299 | 330.422 |
| RxxAL | HhhHH | 97.3 | 50.4 | 1236.5 | 6.745354 | 1.2494e−11 | 0.07869 | 0.04076 | 103 | 117 | 94 | 25.818 |
| VxxxE | HhhhH | 776.9 | 402.6 | 5432.9 | 19.38376 | 8.7489e−84 | 0.142999 | 0.074111 | 810 | 954 | 665 | 148.632 |
| NxxxH | HhhhH | 153.4 | 79.5 | 868.2 | 8.690635 | 3.0194e−18 | 0.176687 | 0.091605 | 158 | 182 | 134 | 32.63 |
| GxW | CeE | 139.7 | 72.4 | 765.8 | 8.306914 | 8.2462e−17 | 0.182424 | 0.09458 | 141 | 158 | 102 | 52.85 |
| IPS | CCC | 86.4 | 44.8 | 533.7 | 6.489723 | 7.1959e−11 | 0.161889 | 0.083976 | 103 | 120 | 80 | 17.239 |
| RxxxL | HhhhH | 1346.1 | 698.5 | 9345.2 | 25.47497 | 3.0835e−143 | 0.144042 | 0.074742 | 1360 | 1568 | 1105 | 261.265 |
| DxY | EeE | 220.1 | 114.3 | 1491.6 | 10.29625 | 6.0672e−25 | 0.14756 | 0.07664 | 237 | 253 | 156 | 49.973 |
| SxxxN | HhhhH | 487.3 | 253.1 | 2480.3 | 15.53476 | 1.6921e−54 | 0.196468 | 0.102045 | 506 | 585 | 397 | 85.22 |
| RxxxI | HhccC | 83 | 43.1 | 667.3 | 6.28049 | 2.7918e−10 | 0.124382 | 0.064612 | 113 | 125 | 104 | 20.075 |
| TxxxF | HhhhH | 143.7 | 74.8 | 2434.2 | 8.087854 | 4.9079e−16 | 0.059034 | 0.030738 | 151 | 194 | 129 | 47.689 |
| QxxID | HhhhH | 80.6 | 42 | 759.4 | 6.135319 | 6.9812e−10 | 0.106136 | 0.055264 | 93 | 99 | 79 | 10.301 |
| ExxR | HhhC | 380.1 | 197.9 | 1322.8 | 14.04151 | 7.4744e−45 | 0.287345 | 0.14963 | 420 | 499 | 318 | 62.185 |
| PGP | CCC | 141.6 | 73.8 | 708.1 | 8.3469 | 5.8862e−17 | 0.199972 | 0.104156 | 122 | 164 | 99 | 15.171 |
| QxN | EeC | 209.1 | 109.1 | 732.3 | 10.37689 | 2.7159e−25 | 0.285539 | 0.148994 | 203 | 230 | 88 | 39.951 |
| LxxxN | HhhhH | 499.1 | 260.5 | 3907.2 | 15.30501 | 5.7912e−53 | 0.127739 | 0.066663 | 507 | 592 | 404 | 98.339 |
| PxxxT | HhhhH | 231.4 | 120.8 | 1405 | 10.5292 | 5.2470e−26 | 0.164698 | 0.085959 | 243 | 272 | 184 | 40.088 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| DxxY | ChhH | 178 | 92.9 | 969.5 | 9.283777 | 1.3630e−20 | 0.1836 | 0.095833 | 206 | 235 | 171 | 43.716 |
| FxxxE | CchhH | 122.3 | 63.9 | 1018.1 | 7.554523 | 3.4465e−14 | 0.120126 | 0.062721 | 143 | 163 | 111 | 22.37 |
| RxxE | ChhH | 293.5 | 153.3 | 1085.3 | 12.21994 | 2.0770e−34 | 0.270432 | 0.141246 | 316 | 371 | 249 | 40.946 |
| NxxxxR | ChhhhH | 126.6 | 66.1 | 967 | 7.704717 | 1.0776e−14 | 0.13092 | 0.068383 | 152 | 165 | 143 | 38.002 |
| YxxxK | HhhhC | 127.5 | 66.6 | 735.6 | 7.820257 | 4.3817e−15 | 0.173328 | 0.090574 | 160 | 167 | 125 | 22.017 |
| AxxQA | HhhHH | 113.8 | 59.5 | 1177.6 | 7.223678 | 4.1184e−13 | 0.096637 | 0.05053 | 135 | 130 | 105 | 15.993 |
| IxxxN | HhhhC | 91.3 | 47.7 | 775.8 | 6.507313 | 6.2714e−11 | 0.117685 | 0.06154 | 111 | 118 | 95 | 9.688 |
| RxxRE | HhhHH | 141.4 | 74 | 828.4 | 8.217981 | 1.7164e−16 | 0.17069 | 0.089275 | 148 | 167 | 139 | 40.58 |
| DxxRA | HhhHH | 112.5 | 58.9 | 823.5 | 7.256832 | 3.2587e−13 | 0.136612 | 0.071469 | 136 | 140 | 120 | 23.245 |
| DxxxxK | CchhH | 102.7 | 53.7 | 685.9 | 6.958082 | 2.8484e−12 | 0.14973 | 0.07834 | 118 | 122 | 92 | 22.493 |
| SxF | CcE | 155.7 | 81.5 | 1168.6 | 8.522011 | 1.2853e−17 | 0.133236 | 0.06974 | 164 | 189 | 98 | 30.377 |
| ALxxE | HHhhH | 108.9 | 57 | 1224.1 | 7.032913 | 1.6407e−12 | 0.088963 | 0.046595 | 126 | 136 | 118 | 18.344 |
| RxxxG | HhhhC | 350.8 | 183.7 | 1570 | 13.1164 | 2.2241e−39 | 0.223439 | 0.117029 | 383 | 456 | 329 | 66.416 |
| FxxxD | HhhhH | 141.6 | 74.2 | 1121 | 8.097839 | 4.5744e−16 | 0.126316 | 0.066187 | 163 | 181 | 136 | 33.51 |
| GxxxxD | CcchhH | 262.4 | 137.5 | 2156 | 11.00743 | 2.8665e−28 | 0.121707 | 0.063779 | 313 | 341 | 244 | 68.196 |
| FxxxK | HhhhH | 433.1 | 227.1 | 3125.6 | 14.19814 | 7.6861e−46 | 0.138565 | 0.072648 | 461 | 528 | 372 | 80.455 |
| LAxxE | HHhhH | 111.2 | 58.3 | 1261.6 | 7.088647 | 1.0966e−12 | 0.088142 | 0.046234 | 119 | 134 | 110 | 18.25 |
| WxxC | EecC | 110 | 57.7 | 703.5 | 7.185905 | 5.5069e−13 | 0.156361 | 0.08202 | 120 | 135 | 76 | 29.586 |
| IxxxE | CchhH | 184.4 | 96.7 | 1441.8 | 9.229114 | 2.2271e−20 | 0.127896 | 0.067089 | 214 | 223 | 179 | 41.502 |
| QExxR | HHhhH | 86.7 | 45.5 | 537.5 | 6.388227 | 1.3886e−10 | 0.161302 | 0.084616 | 105 | 117 | 90 | 16.26 |
| TxxQ | ChhH | 610.7 | 320.4 | 2537.9 | 17.34901 | 1.6872e−67 | 0.240632 | 0.126252 | 622 | 765 | 470 | 110.722 |
| DxxxF | HhhhH | 233.4 | 122.5 | 2397.6 | 10.28331 | 6.7728e−25 | 0.097347 | 0.051142 | 250 | 276 | 206 | 65.429 |
| YxxS | HhhC | 95.6 | 50.2 | 655.1 | 6.67078 | 2.0931e−11 | 0.145932 | 0.076611 | 124 | 131 | 108 | 13.441 |
| KxLG | HhhHC | 102.4 | 53.8 | 672.1 | 6.913764 | 3.8864e−12 | 0.152358 | 0.080006 | 128 | 144 | 109 | 14.959 |
| VxxxY | HhhhH | 206.8 | 108.6 | 3163.8 | 9.585411 | 7.3801e−22 | 0.065364 | 0.034334 | 215 | 230 | 166 | 46.981 |
| SxxxA | CcchhH | 87.1 | 45.8 | 977 | 6.259146 | 3.1360e−10 | 0.08915 | 0.046839 | 109 | 107 | 75 | 14.869 |
| DxxxS | HhhhC | 148.4 | 78.1 | 662.7 | 8.474971 | 1.9691e−17 | 0.223932 | 0.117802 | 169 | 195 | 145 | 20.945 |
| PxxxS | HhhhH | 340.3 | 179 | 1892.8 | 12.66679 | 7.4452e−37 | 0.179787 | 0.094585 | 368 | 431 | 290 | 56.359 |
| YxxQ | HhhH | 398.5 | 209.7 | 2527.7 | 13.61767 | 2.5739e−42 | 0.157653 | 0.082949 | 422 | 461 | 320 | 108.519 |
| GxxxxA | CcchhH | 152 | 80 | 1799.4 | 8.235044 | 1.4447e−16 | 0.084473 | 0.044459 | 171 | 183 | 138 | 54.309 |
| GxH | ChH | 80.3 | 42.3 | 515.6 | 6.100545 | 8.7049e−10 | 0.155741 | 0.08202 | 82 | 102 | 62 | 19.027 |
| QxxxI | HhhhH | 314.8 | 165.8 | 3351.4 | 11.86534 | 1.4406e−32 | 0.093931 | 0.049481 | 329 | 374 | 277 | 59.351 |
| QxY | EeE | 187.6 | 98.9 | 1255.4 | 9.293234 | 1.2227e−20 | 0.149434 | 0.078777 | 177 | 235 | 142 | 33.071 |
| ExxxxY | HhhhhC | 83.5 | 44 | 817.7 | 6.116442 | 7.7550e−10 | 0.102116 | 0.053839 | 103 | 108 | 77 | 31.322 |
| NxxG | HhhC | 203.8 | 107.5 | 867.4 | 9.925044 | 2.7114e−23 | 0.234955 | 0.123919 | 222 | 254 | 190 | 28.398 |
| PxxxQ | ChhhH | 94.4 | 49.8 | 653.3 | 6.577013 | 3.9291e−11 | 0.144497 | 0.076218 | 110 | 121 | 87 | 19.008 |
| NW | CE | 87.6 | 46.2 | 354.5 | 6.527002 | 5.6617e−11 | 0.247109 | 0.13038 | 87 | 105 | 56 | 24.622 |
| AxxAE | HhhHH | 133.4 | 70.4 | 1311.8 | 7.716222 | 9.6679e−15 | 0.101692 | 0.053677 | 154 | 159 | 139 | 22.18 |
| QxxxA | HhhhH | 1147.9 | 606.8 | 7180.5 | 22.96015 | 9.5018e−117 | 0.159864 | 0.084501 | 1109 | 1333 | 879 | 166.872 |
| DGS | CCE | 91.7 | 48.5 | 385.8 | 6.638838 | 2.6538e−11 | 0.237688 | 0.125656 | 99 | 91 | 19 | 9.104 |
| TxEQ | ChHH | 131 | 69.3 | 722.9 | 7.799428 | 5.1196e−15 | 0.181215 | 0.095827 | 142 | 171 | 121 | 24.155 |
| RExxA | HHhhH | 122.1 | 64.6 | 824.6 | 7.452817 | 7.4518e−14 | 0.148072 | 0.078335 | 134 | 164 | 119 | 28.012 |
| TxxxxR | ChhhhH | 192.4 | 101.8 | 1444.8 | 9.314664 | 9.9140e−21 | 0.133167 | 0.070455 | 210 | 243 | 189 | 43.815 |
| TxQ | ChH | 358.8 | 189.9 | 1213.7 | 13.34734 | 1.0422e−40 | 0.295625 | 0.156445 | 359 | 457 | 278 | 57.568 |
| QxxL | ChhH | 83.7 | 44.3 | 539.5 | 6.175187 | 5.4110e−10 | 0.155144 | 0.082143 | 90 | 104 | 69 | 20.665 |
| AxxxS | HhhhH | 815.9 | 432 | 6889.2 | 19.07625 | 3.1981e−81 | 0.118432 | 0.062711 | 858 | 1020 | 704 | 150.248 |
| YxY | EeE | 228.8 | 121.2 | 2218 | 10.05802 | 6.7978e−24 | 0.103156 | 0.054624 | 222 | 239 | 163 | 85.813 |
| NxxxM | HhhhH | 115 | 60.9 | 1093.3 | 7.131459 | 8.0001e−13 | 0.105186 | 0.055715 | 129 | 146 | 91 | 26.339 |
| NxxS | ChhH | 191.8 | 101.6 | 1052.4 | 9.413467 | 3.9388e−21 | 0.18225 | 0.096549 | 203 | 237 | 171 | 61.026 |
| PxxxQ | HhhhH | 489.4 | 259.6 | 2215.5 | 15.18275 | 3.8046e−52 | 0.220898 | 0.117159 | 516 | 612 | 413 | 65.861 |
| RxxxxN | HhhccC | 89 | 47.2 | 591.1 | 6.340961 | 1.8630e−10 | 0.150567 | 0.079865 | 100 | 105 | 80 | 18.617 |
| SxxxS | HhhhH | 612.2 | 324.9 | 3868.8 | 16.65308 | 2.3318e−62 | 0.15824 | 0.083981 | 621 | 709 | 477 | 120.508 |
| DxxxM | HhhhH | 189.7 | 100.7 | 1555.5 | 9.171445 | 3.7589e−20 | 0.121954 | 0.064735 | 193 | 219 | 148 | 37.831 |
| RExxxR | HHhhhH | 94.3 | 50.1 | 805.4 | 6.456703 | 8.6412e−11 | 0.117085 | 0.062155 | 107 | 122 | 98 | 21.898 |
| MxxxV | HhhhH | 130.6 | 69.3 | 2641.7 | 7.453862 | 7.1767e−14 | 0.049438 | 0.026251 | 142 | 155 | 120 | 25.737 |
| NxN | ChH | 250.9 | 133.3 | 909.1 | 11.0311 | 2.2760e−28 | 0.275987 | 0.146586 | 260 | 292 | 201 | 58.012 |
| NxY | CcE | 207.7 | 110.3 | 1062.5 | 9.790792 | 1.0127e−22 | 0.195482 | 0.10385 | 211 | 222 | 130 | 39.035 |
| TxW | EeE | 104.2 | 55.4 | 881.7 | 6.776643 | 9.9170e−12 | 0.118181 | 0.06281 | 107 | 120 | 84 | 28.988 |
| QxxxE | HhhhH | 1661.6 | 884.6 | 7199.7 | 27.89439 | 2.5759e−171 | 0.230787 | 0.122866 | 1626 | 2046 | 1307 | 271.084 |
| NxxxD | HhhhH | 469.1 | 249.9 | 2191.3 | 14.73567 | 3.1263e−49 | 0.214074 | 0.114022 | 479 | 561 | 383 | 103.469 |
| ExxRA | HhhHH | 216.7 | 115.4 | 1491.6 | 9.81248 | 8.0321e−23 | 0.14528 | 0.07739 | 245 | 277 | 198 | 38.212 |
| QxxG | HhhC | 411.9 | 219.5 | 1555.2 | 14.00967 | 1.1350e−44 | 0.264853 | 0.14116 | 472 | 534 | 404 | 65.505 |
| PExxA | HHhhH | 127.9 | 68.2 | 958.9 | 7.506229 | 4.9065e−14 | 0.133382 | 0.071091 | 146 | 162 | 127 | 23.389 |
| AAxxA | HhhhH | 198.7 | 105.9 | 3428 | 9.15901 | 4.1321e−20 | 0.057964 | 0.030896 | 229 | 253 | 204 | 29.277 |
| LSxE | CChH | 112.6 | 60.1 | 832.4 | 7.032831 | 1.6319e−12 | 0.135272 | 0.072187 | 126 | 140 | 103 | 22.548 |
| NxxT | ChhH | 183.6 | 98 | 984.6 | 9.105281 | 7.0144e−20 | 0.186472 | 0.099581 | 196 | 239 | 160 | 39.061 |
| LAxxR | HHhhH | 94.9 | 50.7 | 1122.2 | 6.347006 | 1.7464e−10 | 0.084566 | 0.045204 | 115 | 122 | 104 | 19.449 |
| PxxR | HhhC | 151.1 | 80.8 | 751.3 | 8.279371 | 1.0134e−16 | 0.201118 | 0.107541 | 175 | 195 | 150 | 34.249 |
| RxxxY | HhhhH | 339.3 | 181.6 | 2495.4 | 12.17131 | 3.5410e−34 | 0.13597 | 0.072706 | 345 | 403 | 290 | 74.106 |
| NxxxS | HhhhC | 99.5 | 53.2 | 474.7 | 6.7313 | 1.3826e−11 | 0.209606 | 0.112126 | 132 | 146 | 111 | 12.42 |
| ERG | HCC | 94.3 | 50.4 | 359.7 | 6.658952 | 2.3048e−11 | 0.262163 | 0.140245 | 109 | 112 | 86 | 12.28 |
| TxxxN | HhhhH | 500.1 | 267.6 | 2640.6 | 14.99574 | 6.3579e−51 | 0.189389 | 0.101328 | 526 | 619 | 420 | 87.708 |
| ExxxN | HhhhH | 1238.3 | 662.5 | 5424.4 | 23.87465 | 4.6110e−126 | 0.228283 | 0.122138 | 1208 | 1512 | 928 | 223.973 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| SxxG | HhhC | 347.9 | 186.1 | 1537.7 | 12.6462 | 9.6469e−37 | 0.226247 | 0.121053 | 386 | 448 | 311 | 61.527 |
| QxxxP | HhhhH | 83.8 | 44.8 | 376.3 | 6.199086 | 4.6927e−10 | 0.222695 | 0.119162 | 80 | 94 | 72 | 14.007 |
| QxxR | HhhH | 1231.2 | 658.8 | 5042.5 | 23.91538 | 1.7473e−126 | 0.244165 | 0.130659 | 1202 | 1503 | 918 | 252.525 |
| HxxxV | HhhhH | 215.1 | 115.2 | 2170.1 | 9.570428 | 8.4493e−22 | 0.09912 | 0.053066 | 227 | 314 | 174 | 79.055 |
| PxxxD | HhhhH | 353.7 | 189.5 | 1593.3 | 12.70558 | 4.5110e−37 | 0.221992 | 0.118948 | 379 | 452 | 300 | 59.694 |
| DxA | ChH | 999.6 | 535.7 | 3592.5 | 21.7314 | 8.6234e−105 | 0.278246 | 0.149103 | 966 | 1249 | 763 | 132.834 |
| PxxxH | HhhhH | 126 | 67.5 | 704.1 | 7.482894 | 5.9047e−14 | 0.178952 | 0.095911 | 124 | 135 | 94 | 21.949 |
| GFS | CCC | 100.2 | 53.7 | 618 | 6.636855 | 2.5936e−11 | 0.162136 | 0.086923 | 112 | 126 | 86 | 27.305 |
| ExxH | HhhH | 621.9 | 333.5 | 3030.1 | 16.73683 | 5.7488e−63 | 0.205241 | 0.110077 | 623 | 720 | 476 | 164.84 |
| VxxxH | HhhhH | 729.3 | 391.2 | 5584 | 17.72605 | 2.1028e−70 | 0.130605 | 0.070058 | 775 | 877 | 628 | 153.549 |
| NH | CE | 115.1 | 61.8 | 505.6 | 7.245883 | 3.5376e−13 | 0.22765 | 0.122134 | 110 | 125 | 71 | 57.137 |
| ExxxS | HhhhH | 1260.4 | 676.4 | 5947.2 | 23.85331 | 7.6202e−126 | 0.211932 | 0.113731 | 1205 | 1521 | 959 | 217.551 |
| SxS | ChH | 515.9 | 277 | 2080.1 | 15.41924 | 1.0009e−53 | 0.248017 | 0.133156 | 515 | 629 | 395 | 104.302 |
| GxxxH | HhhhH | 97.2 | 52.2 | 842.6 | 6.433257 | 9.9704e−11 | 0.115357 | 0.061937 | 105 | 128 | 93 | 24.109 |
| QxxxN | HhhC | 128.4 | 69 | 622.1 | 7.588773 | 2.6375e−14 | 0.206398 | 0.11087 | 145 | 165 | 124 | 21.509 |
| RxxxxE | CchhH | 143.1 | 76.9 | 1123 | 7.824477 | 4.0696e−15 | 0.127427 | 0.068462 | 170 | 180 | 127 | 25.24 |
| AxP | HcH | 82.6 | 44.4 | 318.3 | 6.184656 | 5.1804e−10 | 0.259504 | 0.139426 | 89 | 108 | 80 | 13.458 |
| SxxE | ChhH | 1232.3 | 662.1 | 5215.8 | 23.71508 | 2.0648e−124 | 0.236263 | 0.126945 | 1246 | 1512 | 984 | 208.985 |
| WxD | EeE | 90.7 | 48.7 | 612.9 | 6.265784 | 2.9867e−10 | 0.147985 | 0.079514 | 90 | 101 | 68 | 39.123 |
| ExxxA | HhhhC | 332.6 | 178.8 | 1550.9 | 12.22687 | 1.8204e−34 | 0.214456 | 0.115297 | 412 | 451 | 342 | 47.966 |
| AxxxD | HhhhH | 831.5 | 447.2 | 4633.8 | 19.12119 | 1.3547e−81 | 0.179442 | 0.0965 | 825 | 1000 | 633 | 138.75 |
| LxxxE | HhhhH | 1373.5 | 739.2 | 9254.6 | 24.31423 | 1.1055e−130 | 0.148391 | 0.079879 | 1341 | 1609 | 1068 | 245.576 |
| FxxxT | HhhhH | 146.5 | 78.9 | 2060.1 | 7.767194 | 6.3018e−15 | 0.071113 | 0.038279 | 151 | 172 | 132 | 56.842 |
| SxxxS | HhhhC | 130.9 | 70.5 | 730.4 | 7.568994 | 3.0401e−14 | 0.179217 | 0.096515 | 167 | 178 | 136 | 22.746 |
| KxxxxS | HhhccC | 110.1 | 59.3 | 783.2 | 6.858237 | 5.5792e−12 | 0.140577 | 0.075739 | 133 | 143 | 120 | 23.932 |
| KKxG | HHcC | 84.7 | 45.7 | 401.4 | 6.137295 | 6.8615e−10 | 0.211011 | 0.11375 | 101 | 108 | 85 | 7.445 |
| YxG | EcC | 388.8 | 209.7 | 2305.9 | 12.97474 | 1.3641e−38 | 0.168611 | 0.090928 | 444 | 471 | 282 | 104.142 |
| NxR | ChH | 288.4 | 155.7 | 1067.1 | 11.50362 | 1.0444e−30 | 0.270265 | 0.145939 | 299 | 351 | 241 | 95.177 |
| TxxR | ChhH | 169.2 | 91.4 | 764.8 | 8.674858 | 3.3736e−18 | 0.221234 | 0.119488 | 181 | 197 | 129 | 46.634 |
| QxxxD | HhhhC | 139.6 | 75.5 | 622.3 | 7.877462 | 2.7252e−15 | 0.224329 | 0.121252 | 167 | 191 | 146 | 19.277 |
| PxxxV | HhhhH | 137.8 | 74.5 | 1643.4 | 7.506602 | 4.7630e−14 | 0.083851 | 0.04533 | 135 | 150 | 113 | 41.962 |
| SxxxN | HhhhC | 129.1 | 69.8 | 738.4 | 7.458508 | 7.0377e−14 | 0.174837 | 0.094534 | 143 | 167 | 126 | 24.018 |
| LxxE | ChhH | 118.3 | 64 | 675.1 | 7.137447 | 7.6498e−13 | 0.175233 | 0.094773 | 129 | 151 | 120 | 23.095 |
| SxxxA | HhhhH | 836.8 | 452.6 | 7696.8 | 18.61578 | 1.8805e−77 | 0.108721 | 0.058802 | 847 | 1011 | 693 | 157.111 |
| VxxxH | HhhhH | 249.5 | 135 | 1847.5 | 10.23183 | 1.1317e−24 | 0.135047 | 0.073088 | 272 | 319 | 238 | 36.088 |
| TxR | HcC | 155.6 | 84.2 | 603.3 | 8.385416 | 4.1571e−17 | 0.257915 | 0.139598 | 166 | 212 | 128 | 41.373 |
| SxxxI | HhhhH | 210.2 | 113.8 | 3246.1 | 9.197422 | 2.8543e−20 | 0.064755 | 0.035062 | 229 | 263 | 191 | 55.294 |
| QxI | EeE | 286.5 | 155.2 | 2264.8 | 10.92249 | 7.1076e−28 | 0.126501 | 0.068519 | 289 | 334 | 222 | 58.719 |
| RxxxI | HhhhH | 534.3 | 289.5 | 4313.7 | 14.89561 | 2.7733e−50 | 0.123861 | 0.067113 | 575 | 665 | 450 | 135.719 |
| TKV | EEE | 147.9 | 80.2 | 815.1 | 7.963248 | 1.3456e−15 | 0.18145 | 0.098379 | 163 | 77 | 26 | 17.155 |
| PxxQ | HhhC | 103.2 | 56 | 409.4 | 6.796772 | 8.7895e−12 | 0.252076 | 0.136685 | 118 | 126 | 92 | 20.413 |
| DxR | ChH | 544.4 | 295.2 | 1961.9 | 15.73644 | 7.0040e−56 | 0.277486 | 0.150465 | 554 | 668 | 460 | 83.291 |
| ExxRE | HhhHH | 240.2 | 130.3 | 1378.1 | 10.11552 | 3.7685e−24 | 0.174298 | 0.094564 | 265 | 290 | 224 | 43.827 |
| KxxxxE | HhhhcC | 89.5 | 48.6 | 591.6 | 6.130528 | 6.9930e−10 | 0.151413 | 0.082166 | 111 | 120 | 96 | 19.403 |
| RxxxD | CchhH | 159.2 | 86.4 | 800.2 | 8.292371 | 8.9467e−17 | 0.19895 | 0.107974 | 163 | 189 | 130 | 22.888 |
| RxxxV | HhhhH | 506 | 274.6 | 3969.3 | 14.47043 | 1.4670e−47 | 0.127478 | 0.069191 | 534 | 589 | 412 | 103.446 |
| ExxxF | HhhhH | 498.5 | 270.6 | 4158.3 | 14.32931 | 1.1281e−46 | 0.119881 | 0.065072 | 514 | 578 | 426 | 102.392 |
| GxW | CcE | 181.9 | 98.7 | 1119.5 | 8.764418 | 1.4965e−18 | 0.162483 | 0.088199 | 181 | 213 | 154 | 55.342 |
| QF | HC | 113.5 | 61.6 | 439.7 | 7.122281 | 8.7171e−13 | 0.258131 | 0.140203 | 123 | 141 | 96 | 23.442 |
| MxxxD | CchhH | 103.9 | 56.5 | 674.3 | 6.595457 | 3.3788e−11 | 0.154086 | 0.083733 | 111 | 126 | 92 | 15.303 |
| QxxxS | HhhhC | 134.1 | 72.9 | 655.1 | 7.607364 | 2.2573e−14 | 0.204702 | 0.111245 | 169 | 191 | 145 | 18.473 |
| SxN | ChH | 239 | 129.9 | 996.5 | 10.26369 | 8.3511e−25 | 0.239839 | 0.130365 | 248 | 300 | 185 | 39.767 |
| ExxxI | HhhhH | 758.2 | 412.4 | 6102.5 | 17.63348 | 1.0697e−69 | 0.124244 | 0.067581 | 799 | 923 | 676 | 129.885 |
| LxxxR | HhhhC | 145 | 78.9 | 1150.8 | 7.709134 | 9.9857e−15 | 0.125999 | 0.068569 | 167 | 189 | 154 | 41.153 |
| PxxxA | HhhhH | 816.8 | 444.6 | 6116.7 | 18.33146 | 3.6493e−75 | 0.133536 | 0.072684 | 847 | 1009 | 697 | 134.217 |
| ExxxH | HhhhH | 551.7 | 300 | 2737.5 | 15.36047 | 2.4145e−53 | 0.201315 | 0.109602 | 593 | 676 | 485 | 111.491 |
| NxxR | HhhH | 887.4 | 483.2 | 3933.1 | 19.63215 | 6.6235e−86 | 0.225624 | 0.12286 | 878 | 1025 | 668 | 165.101 |
| DxxR | HhhC | 164.8 | 89.8 | 640.4 | 8.54263 | 1.0720e−17 | 0.257339 | 0.140153 | 182 | 212 | 152 | 29.523 |
| LxxxQ | HhhhC | 114.8 | 62.5 | 916.8 | 6.847902 | 5.9099e−12 | 0.125218 | 0.068204 | 154 | 153 | 122 | 16.295 |
| AxxRE | HhhHH | 138.9 | 75.7 | 940.9 | 7.575524 | 2.8327e−14 | 0.147625 | 0.080452 | 161 | 186 | 144 | 21.306 |
| NxQ | ChH | 274.2 | 149.6 | 988.7 | 11.05835 | 1.6363e−28 | 0.277334 | 0.151307 | 286 | 338 | 234 | 51.75 |
| NxxF | ChhH | 101.1 | 55.2 | 919.8 | 6.376146 | 1.4250e−10 | 0.109915 | 0.05999 | 117 | 125 | 105 | 16.826 |
| MxxxE | HhhhH | 326.7 | 178.4 | 2165.2 | 11.59541 | 3.4291e−31 | 0.150887 | 0.082375 | 335 | 380 | 287 | 62.542 |
| RxxxW | HhhhH | 132.1 | 72.2 | 1089.8 | 7.303532 | 2.2005e−13 | 0.121215 | 0.066206 | 140 | 142 | 113 | 23.636 |
| DxxR | HhhH | 1950.8 | 1065.5 | 7576.4 | 29.25448 | 3.1941e−188 | 0.257484 | 0.140641 | 1854 | 2324 | 1449 | 369.877 |
| RxxD | HhhC | 173.2 | 94.6 | 764 | 8.632735 | 4.8346e−18 | 0.226702 | 0.123828 | 178 | 201 | 123 | 28.849 |
| NxxN | HhhH | 471.7 | 257.7 | 2067.4 | 14.2519 | 3.5119e−46 | 0.228161 | 0.12463 | 465 | 568 | 381 | 98.052 |
| TxxxD | HhhhH | 397.4 | 217.1 | 1987.2 | 12.96478 | 1.5476e−38 | 0.19998 | 0.109253 | 415 | 496 | 340 | 67.131 |
| LxxxA | CchhH | 132.5 | 72.4 | 1419 | 7.243531 | 3.4043e−13 | 0.093376 | 0.051052 | 155 | 175 | 146 | 29.062 |
| ExxLA | HhhHH | 172.9 | 94.5 | 1763.6 | 8.285516 | 9.1556e−17 | 0.098038 | 0.053601 | 196 | 212 | 171 | 23.309 |
| WxG | EcC | 102.7 | 56.2 | 603 | 6.522579 | 5.5005e−11 | 0.170315 | 0.093124 | 109 | 126 | 91 | 36.57 |
| QxxxR | HhhcC | 88.9 | 48.6 | 430.5 | 6.128779 | 7.1237e−10 | 0.206504 | 0.112991 | 106 | 124 | 86 | 12.945 |
| EQxxA | HHhhH | 117.1 | 64.1 | 862.2 | 6.87733 | 4.7983e−12 | 0.135815 | 0.074365 | 136 | 154 | 116 | 23.779 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| RxxxK | HhhhC | 144.3 | 79 | 584.7 | 7.89474 | 2.3580e−15 | 0.246793 | 0.135166 | 181 | 217 | 161 | 27.224 |
| MxxxQ | HhhhH | 185.4 | 101.6 | 1387.6 | 8.640563 | 4.3854e−18 | 0.133612 | 0.073196 | 197 | 225 | 159 | 33.442 |
| SxxxxN | ChhhhH | 104.2 | 57.1 | 951.4 | 6.431759 | 9.8602e−11 | 0.109523 | 0.060001 | 125 | 133 | 106 | 18.869 |
| QxxN | HhhC | 139 | 76.2 | 567.1 | 7.738658 | 8.1377e−15 | 0.245107 | 0.134302 | 152 | 182 | 130 | 12.68 |
| NxxA | ChhH | 312.9 | 171.5 | 1945.5 | 11.30439 | 9.8336e−30 | 0.160833 | 0.088165 | 329 | 396 | 273 | 78.395 |
| SxxxV | HhhhH | 229.5 | 125.8 | 3159.2 | 9.431813 | 3.1065e−21 | 0.072645 | 0.039829 | 236 | 264 | 188 | 73.259 |
| ExW | EeE | 134.4 | 73.7 | 812.2 | 7.414472 | 9.6618e−14 | 0.165476 | 0.090745 | 145 | 157 | 92 | 29.744 |
| AxxxN | HhhhH | 512.5 | 281.1 | 3692.5 | 14.35617 | 7.6211e−47 | 0.138795 | 0.076137 | 534 | 649 | 438 | 86.064 |
| RxxxN | HhhhC | 140.5 | 77.1 | 622.6 | 7.716933 | 9.5838e−15 | 0.225667 | 0.123805 | 164 | 183 | 130 | 24.647 |
| YPE | CCC | 91.8 | 50.4 | 488 | 6.162289 | 5.7200e−10 | 0.188115 | 0.103238 | 100 | 112 | 83 | 19.149 |
| EExxS | HHhhH | 108.6 | 59.6 | 688.3 | 6.641035 | 2.4611e−11 | 0.15778 | 0.086591 | 112 | 127 | 82 | 21.926 |
| TxxxM | HhhhH | 152.5 | 83.7 | 2133.3 | 7.669962 | 1.3266e−14 | 0.071485 | 0.039242 | 160 | 182 | 126 | 40.979 |
| ExxxxR | HhhhcC | 110.3 | 60.6 | 819.7 | 6.641153 | 2.4426e−11 | 0.134561 | 0.073884 | 136 | 139 | 121 | 21.653 |
| LxS | CcH | 171 | 93.9 | 1159.4 | 8.298469 | 8.2824e−17 | 0.14749 | 0.080997 | 188 | 204 | 133 | 31.574 |
| RExxR | HHhhH | 155 | 85.2 | 968.1 | 7.921336 | 1.8513e−15 | 0.160107 | 0.087988 | 177 | 191 | 146 | 31.035 |
| SxT | ChH | 257.9 | 141.7 | 1197.1 | 10.3912 | 2.1709e−25 | 0.215437 | 0.118404 | 266 | 323 | 223 | 60.37 |
| AxxEA | HhhHH | 188.2 | 103.4 | 2180.2 | 8.538938 | 1.0460e−17 | 0.086322 | 0.047445 | 224 | 245 | 202 | 24.32 |
| PxxQ | ChhH | 184.4 | 101.4 | 1437.5 | 8.554163 | 9.2654e−18 | 0.128278 | 0.070517 | 189 | 215 | 148 | 33.065 |
| ExR | CeE | 196.5 | 108 | 664.3 | 9.299003 | 1.1605e−20 | 0.2958 | 0.162652 | 192 | 229 | 142 | 63.117 |
| GxxxS | HhhhH | 289.5 | 159.2 | 2551.2 | 10.66269 | 1.1802e−26 | 0.113476 | 0.06241 | 307 | 350 | 258 | 47.168 |
| TxxE | EhhH | 206.1 | 113.4 | 865.3 | 9.344617 | 7.4132e−21 | 0.238183 | 0.131001 | 237 | 251 | 121 | 20.44 |
| QxxxP | HhhcC | 133.5 | 73.4 | 676.1 | 7.423599 | 9.0723e−14 | 0.197456 | 0.108619 | 153 | 159 | 130 | 20.698 |
| TGP | CCC | 102.8 | 56.6 | 563.2 | 6.483433 | 7.1185e−11 | 0.182496 | 0.100399 | 112 | 129 | 81 | 24.898 |
| NxxE | ChhH | 661 | 364 | 2655.9 | 16.75865 | 3.9327e−63 | 0.24888 | 0.137048 | 683 | 804 | 530 | 104.308 |
| SxxT | ChhH | 228.9 | 126.1 | 1458.1 | 9.579028 | 7.6814e−22 | 0.156985 | 0.086477 | 245 | 277 | 190 | 35.722 |
| DxxxQ | HhhhH | 930.8 | 512.8 | 4144.6 | 19.71989 | 1.1598e−86 | 0.224581 | 0.123724 | 958 | 1133 | 786 | 146.545 |
| RxxxxN | HhhhhC | 97.2 | 53.6 | 765.7 | 6.176601 | 5.1150e−10 | 0.126943 | 0.069993 | 121 | 129 | 105 | 29.151 |
| ExxxL | HhhhH | 1724.7 | 952.4 | 13302.4 | 25.97313 | 7.7159e−149 | 0.129653 | 0.071595 | 1714 | 2036 | 1346 | 325.45 |
| SxxxxQ | ChhhhH | 176.9 | 97.8 | 1537.4 | 8.267115 | 1.0620e−16 | 0.115064 | 0.063607 | 215 | 218 | 163 | 45.171 |
| YxxxI | HhhhH | 181.2 | 100.2 | 3381.2 | 8.207699 | 1.7172e−16 | 0.05359 | 0.029649 | 209 | 227 | 176 | 42.552 |
| SxR | ChH | 317.2 | 175.7 | 1335.1 | 11.46073 | 1.6564e−30 | 0.237585 | 0.131564 | 313 | 366 | 248 | 69.543 |
| EExxR | HHhhH | 314.5 | 174.2 | 1989.2 | 11.12684 | 7.2386e−29 | 0.158104 | 0.08758 | 353 | 399 | 306 | 47.077 |
| QxxY | HhhH | 320.8 | 177.7 | 2179.5 | 11.20057 | 3.1483e−29 | 0.14719 | 0.081535 | 333 | 398 | 264 | 75.096 |
| KxxxF | HhhhH | 328.2 | 181.8 | 2569.5 | 11.25855 | 1.6248e−29 | 0.127729 | 0.070772 | 360 | 395 | 288 | 57.303 |
| ExxAA | HhhhH | 179.9 | 99.7 | 1794.4 | 8.26671 | 1.0592e−16 | 0.100256 | 0.055555 | 224 | 250 | 194 | 27.795 |
| SGY | CCC | 105.1 | 58.2 | 565.7 | 6.482485 | 7.1196e−11 | 0.185788 | 0.102958 | 112 | 115 | 69 | 28.239 |
| AxxxA | HhhhC | 318.2 | 176.4 | 2577.6 | 11.06323 | 1.4602e−28 | 0.123448 | 0.06843 | 397 | 453 | 358 | 43.621 |
| RxxxxK | HhhccC | 99.7 | 55.3 | 673.8 | 6.235508 | 3.5171e−10 | 0.147967 | 0.082043 | 118 | 133 | 101 | 21.553 |
| AxxxA | HhhhH | 2239.1 | 1243.1 | 25522.9 | 28.96403 | 1.4239e−184 | 0.087729 | 0.048705 | 1979 | 2515 | 1570 | 377.986 |
| DxxxN | HhhhH | 594.3 | 330.2 | 2767.7 | 15.48977 | 3.2073e−54 | 0.214727 | 0.119292 | 614 | 755 | 502 | 85.14 |
| KxxxxD | HhcccC | 159.3 | 88.5 | 1094.7 | 7.848456 | 3.2713e−15 | 0.145519 | 0.080853 | 193 | 202 | 143 | 24.959 |
| AxxLA | HhhHH | 115.6 | 64.3 | 3480.5 | 6.461798 | 7.8277e−11 | 0.033214 | 0.018467 | 137 | 144 | 127 | 20.514 |
| QxxxL | HhccC | 108.8 | 60.5 | 724.2 | 6.486287 | 6.8524e−11 | 0.150235 | 0.083542 | 127 | 143 | 117 | 20.405 |
| TxxG | HhhC | 243.8 | 135.6 | 1055.4 | 9.954431 | 1.9130e−23 | 0.231002 | 0.128472 | 279 | 356 | 223 | 35.359 |
| PxxR | HhhH | 724.7 | 403.3 | 3049 | 17.17996 | 2.9726e−66 | 0.237684 | 0.132276 | 728 | 858 | 571 | 110.512 |
| DAxxA | HHhhH | 128.3 | 71.5 | 1234 | 6.928395 | 3.2679e−12 | 0.103971 | 0.057905 | 153 | 166 | 139 | 15.792 |
| TxxE | ChhH | 1201.2 | 669 | 5025.4 | 22.09925 | 2.5443e−108 | 0.239026 | 0.133125 | 1180 | 1477 | 841 | 166.071 |
| HxxxK | HhhhH | 307.2 | 171.1 | 1546.2 | 11.03354 | 2.0648e−28 | 0.198681 | 0.110656 | 328 | 403 | 273 | 68.068 |
| TxxxI | HhhhH | 254.2 | 141.6 | 4781.1 | 9.604289 | 5.7955e−22 | 0.053168 | 0.029619 | 269 | 294 | 224 | 58.776 |
| ExxxH | HhccC | 125.6 | 70 | 603.3 | 7.072015 | 1.2049e−12 | 0.208188 | 0.115991 | 152 | 164 | 101 | 33.629 |
| HxY | EeE | 116.4 | 64.9 | 1054 | 6.606772 | 3.0212e−11 | 0.110436 | 0.061534 | 129 | 152 | 99 | 42.479 |
| SxxY | ChhH | 128.7 | 71.7 | 933.9 | 7.000372 | 1.9754e−12 | 0.137809 | 0.07681 | 138 | 159 | 100 | 31.063 |
| SxH | ChH | 103.8 | 57.9 | 491.9 | 6.428179 | 1.0206e−10 | 0.211018 | 0.11764 | 112 | 118 | 84 | 36.881 |
| HxxH | HhhH | 144.4 | 80.6 | 873.5 | 7.464091 | 6.5267e−14 | 0.165312 | 0.092235 | 152 | 172 | 131 | 40.043 |
| TxxxA | HhhhH | 589.6 | 329 | 6537.3 | 14.74006 | 2.7084e−49 | 0.09019 | 0.050333 | 586 | 719 | 479 | 134.41 |
| YQ | EC | 128.6 | 71.9 | 489.2 | 7.264749 | 2.9907e−13 | 0.263287 | 0.146984 | 131 | 153 | 90 | 23.614 |
| KVD | EEE | 140.3 | 78.3 | 634.6 | 7.478628 | 5.9323e−14 | 0.221084 | 0.123433 | 152 | 79 | 15 | 14.974 |
| DxxG | HhhC | 433.3 | 241.9 | 1739.4 | 13.26116 | 3.0841e−40 | 0.249109 | 0.139082 | 486 | 577 | 385 | 81.211 |
| AxxG | HhhC | 719.2 | 401.3 | 3735.5 | 16.75324 | 4.1779e−63 | 0.192531 | 0.107594 | 792 | 947 | 645 | 132.901 |
| RxxxD | HhhhC | 158.5 | 88.6 | 698.8 | 7.943242 | 1.5551e−15 | 0.226817 | 0.126824 | 189 | 210 | 165 | 39.63 |
| DxS | ChH | 748.1 | 418.8 | 2698 | 17.51035 | 9.5251e−69 | 0.277279 | 0.15521 | 787 | 947 | 603 | 113.524 |
| DxxxS | HhhhH | 723.1 | 404.9 | 3662.5 | 16.77093 | 3.1011e−63 | 0.197433 | 0.110539 | 766 | 890 | 604 | 85.339 |
| RAxxA | HHhhH | 103.1 | 57.8 | 1074 | 6.131959 | 6.6253e−10 | 0.095996 | 0.053785 | 113 | 124 | 100 | 18.536 |
| GLN | CCC | 129 | 72.3 | 760.8 | 7.013456 | 1.8054e−12 | 0.169558 | 0.095002 | 132 | 159 | 111 | 25.459 |
| NxG | ChH | 179.9 | 101 | 926.1 | 8.318476 | 6.9400e−17 | 0.194255 | 0.109052 | 183 | 215 | 142 | 55.758 |
| SxN | HcC | 189.6 | 106.4 | 732.9 | 8.717704 | 2.2519e−18 | 0.258698 | 0.145238 | 193 | 209 | 143 | 29.06 |
| SxxN | ChhH | 188.3 | 105.7 | 1076.5 | 8.458003 | 2.1068e−17 | 0.174919 | 0.098204 | 217 | 249 | 167 | 42.44 |
| HxxR | HhhH | 430.4 | 241.7 | 2107.3 | 12.90365 | 3.3433e−38 | 0.204246 | 0.114677 | 460 | 530 | 368 | 106.265 |
| PxGP | CcCC | 106.8 | 60 | 744.8 | 6.307076 | 2.1915e−10 | 0.143394 | 0.080514 | 96 | 126 | 75 | 24.033 |
| DxxS | ChhH | 389.9 | 219.1 | 1996.9 | 12.23393 | 1.5902e−34 | 0.195253 | 0.109696 | 439 | 515 | 367 | 50.824 |
| PF | EE | 115.2 | 64.7 | 915.2 | 6.507713 | 5.8473e−11 | 0.125874 | 0.070726 | 123 | 150 | 98 | 38.148 |
| DxxxN | HhhhC | 170.6 | 95.9 | 797.1 | 8.136831 | 3.1755e−16 | 0.214026 | 0.120277 | 192 | 216 | 157 | 29.035 |
| DxxxxR | ChhhhH | 237 | 133.2 | 1783.5 | 9.344319 | 7.0694e−21 | 0.132885 | 0.07471 | 276 | 303 | 240 | 48.784 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| LxA | CcH | 231.9 | 130.5 | 1826.3 | 9.214022 | 2.3961e-20 | 0.126978 | 0.071445 | 258 | 280 | 204 | 51.249 |
| AExxR | HHhhH | 179.1 | 100.8 | 1506.8 | 8.070792 | 5.3200e-16 | 0.118861 | 0.06691 | 205 | 232 | 179 | 43.419 |
| ExF | EeE | 256.9 | 144.6 | 1850.1 | 9.723236 | 1.8348e-22 | 0.138857 | 0.078174 | 265 | 291 | 209 | 54.885 |
| VxxxT | HhhhH | 299.7 | 168.8 | 3669.7 | 10.31987 | 4.3157e-25 | 0.081669 | 0.045987 | 328 | 393 | 253 | 77.133 |
| MxxxK | HhhhH | 312.3 | 175.9 | 2060 | 10.75693 | 4.2120e-27 | 0.151602 | 0.085374 | 342 | 376 | 280 | 61.438 |
| SxQ | HcC | 103.6 | 58.4 | 439.2 | 6.360122 | 1.5890e-10 | 0.235883 | 0.132871 | 118 | 139 | 102 | 20.556 |
| KxxxR | HhhhH | 1011.6 | 569.9 | 4523.9 | 19.79197 | 2.7224e-87 | 0.223612 | 0.125972 | 1037 | 1244 | 835 | 185.843 |
| GFT | CCC | 104.1 | 58.7 | 639.9 | 6.224044 | 3.7409e-10 | 0.162682 | 0.091679 | 116 | 119 | 70 | 12.583 |
| LxxxM | HhhhH | 250.7 | 141.3 | 5646.8 | 9.315799 | 9.0317e-21 | 0.044397 | 0.02503 | 266 | 296 | 217 | 74.072 |
| SxxxE | HhhhH | 986.8 | 556.7 | 5025.9 | 19.33109 | 2.2728e-83 | 0.196343 | 0.110765 | 1001 | 1185 | 801 | 180.213 |
| FxxG | HhhC | 119.4 | 67.4 | 990.8 | 6.56576 | 3.9456e-11 | 0.120509 | 0.067998 | 131 | 155 | 116 | 29.313 |
| AAxxE | HHhhH | 158.9 | 89.7 | 1585.3 | 7.528216 | 3.8940e-14 | 0.100233 | 0.056558 | 183 | 206 | 146 | 24.986 |
| DxxxA | HhhhC | 164 | 92.6 | 833.8 | 7.873273 | 2.6801e-15 | 0.19669 | 0.111028 | 203 | 231 | 171 | 17.346 |
| KxxxxE | CcchhH | 180.8 | 102.1 | 1300.8 | 8.119417 | 3.5770e-16 | 0.138991 | 0.078458 | 213 | 237 | 161 | 45.712 |
| ExxxE | HhhhH | 2968.6 | 1676.2 | 12774.8 | 33.86629 | 1.6289e-251 | 0.232379 | 0.131213 | 2577 | 3429 | 1992 | 488.767 |
| AxxxG | HhhhC | 447.2 | 252.6 | 5044.8 | 12.5614 | 2.5867e-36 | 0.088646 | 0.050074 | 538 | 589 | 468 | 105.023 |
| GYS | CCC | 109.9 | 62.1 | 605.1 | 6.400729 | 1.1963e-10 | 0.181623 | 0.10265 | 125 | 136 | 79 | 36.053 |
| VxxxH | HhhhH | 143.8 | 81.3 | 1671.8 | 7.107051 | 8.9332e-13 | 0.086015 | 0.048628 | 177 | 191 | 154 | 30.317 |
| YxP | EeC | 128.5 | 72.7 | 1189.1 | 6.761517 | 1.0351e-11 | 0.108065 | 0.061101 | 133 | 144 | 99 | 24.258 |
| FxxQ | HhhH | 302.1 | 170.8 | 2695.6 | 10.37972 | 2.3182e-25 | 0.112072 | 0.063367 | 323 | 362 | 272 | 94.274 |
| DxQ | ChH | 411.3 | 232.6 | 1454.6 | 12.78192 | 1.6375e-37 | 0.282758 | 0.159919 | 430 | 503 | 326 | 66.463 |
| PxxxxE | CcchhH | 149.8 | 84.8 | 1475.9 | 7.272421 | 2.6673e-13 | 0.101497 | 0.057448 | 174 | 190 | 151 | 32.295 |
| NxxF | HhhH | 192.4 | 108.9 | 1955.4 | 8.229704 | 1.4145e-16 | 0.098394 | 0.055709 | 197 | 227 | 159 | 41.112 |
| KxxxG | HhhhC | 339.7 | 192.3 | 1593.3 | 11.33192 | 7.0668e-30 | 0.213205 | 0.120714 | 385 | 430 | 297 | 56.247 |
| TxxxS | HhhhH | 331.2 | 187.6 | 2557.8 | 10.89634 | 9.0941e-28 | 0.129486 | 0.073325 | 363 | 417 | 288 | 67.112 |
| MxxxS | HhhhH | 123.1 | 69.7 | 1368.3 | 6.561394 | 4.0179e-11 | 0.089966 | 0.050958 | 127 | 144 | 112 | 21.828 |
| SxT | HcE | 136.9 | 77.6 | 476 | 7.363809 | 1.4202e-13 | 0.287605 | 0.162952 | 152 | 89 | 10 | 15.595 |
| DxxxE | HhhhC | 108.3 | 61.4 | 472.6 | 6.422578 | 1.0479e-10 | 0.229158 | 0.129851 | 127 | 143 | 99 | 30.155 |
| KExG | HHhC | 110.3 | 62.5 | 581.6 | 6.398256 | 1.2154e-10 | 0.189649 | 0.107478 | 136 | 145 | 117 | 18.342 |
| YPG | CCC | 106.2 | 60.2 | 731.8 | 6.187731 | 4.6651e-10 | 0.145122 | 0.08227 | 120 | 121 | 81 | 23.496 |
| EF | HC | 151.8 | 86.1 | 660.5 | 7.589196 | 2.5096e-14 | 0.229826 | 0.13039 | 170 | 189 | 133 | 13.525 |
| RxD | ChH | 290.3 | 164.7 | 1023 | 10.67984 | 9.9908e-27 | 0.283773 | 0.16104 | 284 | 353 | 222 | 49.531 |
| NxxG | EecC | 130.7 | 74.2 | 683.8 | 6.949277 | 2.8332e-12 | 0.191138 | 0.10849 | 128 | 157 | 103 | 42.528 |
| PxxR | ChhH | 169.9 | 96.5 | 683.6 | 8.064812 | 5.7408e-16 | 0.248537 | 0.141143 | 202 | 229 | 165 | 39.661 |
| RxxG | EecC | 324 | 184.1 | 1428.3 | 11.04835 | 1.7317e-28 | 0.226843 | 0.128867 | 327 | 383 | 243 | 62.915 |
| PxxxQ | CchhH | 123 | 69.9 | 1169 | 6.551141 | 4.3072e-11 | 0.105218 | 0.059789 | 136 | 153 | 116 | 28.429 |
| PxxxxL | CchhH | 111.9 | 63.6 | 2362.3 | 6.141216 | 6.0977e-10 | 0.047369 | 0.026919 | 141 | 151 | 118 | 21.802 |
| NxxxA | HhhhH | 576.4 | 327.6 | 4736.9 | 14.24538 | 3.6065e-46 | 0.121683 | 0.069165 | 609 | 710 | 517 | 99.648 |
| LxQ | CcH | 123 | 69.9 | 744.9 | 6.668314 | 1.9809e-11 | 0.165123 | 0.093867 | 133 | 149 | 110 | 24.111 |
| SxxN | HhhC | 140 | 79.6 | 683.6 | 7.198864 | 4.6921e-13 | 0.204798 | 0.116473 | 160 | 180 | 127 | 20.347 |
| ExxxN | HhhhC | 264.5 | 150.5 | 1213.4 | 9.931293 | 2.3526e-23 | 0.217983 | 0.124013 | 322 | 370 | 285 | 39.172 |
| NxxD | ChhH | 392.2 | 223.3 | 1771.2 | 12.09121 | 9.0805e-34 | 0.221432 | 0.126069 | 395 | 486 | 316 | 65.36 |
| PxH | ChH | 116.7 | 66.4 | 517 | 6.603483 | 3.1220e-11 | 0.225725 | 0.128528 | 119 | 140 | 88 | 23.335 |
| HxxQ | HhhH | 282.1 | 160.6 | 1397.3 | 10.18639 | 1.7536e-24 | 0.201889 | 0.114965 | 289 | 349 | 237 | 51.295 |
| RF | HC | 157.1 | 89.5 | 702 | 7.654627 | 1.5033e-14 | 0.223789 | 0.127447 | 178 | 211 | 155 | 21.792 |
| SxxxE | CchhH | 215.2 | 122.7 | 1155.5 | 8.838949 | 7.3988e-19 | 0.18624 | 0.106146 | 251 | 288 | 203 | 31.997 |
| GxxxR | HhhhH | 452.9 | 258.2 | 3346.3 | 12.61114 | 1.3818e-36 | 0.135344 | 0.077167 | 493 | 565 | 420 | 109.722 |
| RxY | EeE | 321.4 | 183.3 | 2132.7 | 10.66632 | 1.1077e-26 | 0.150701 | 0.08596 | 342 | 399 | 275 | 84.119 |
| SxE | ChH | 1700.4 | 969.9 | 6349.9 | 25.48157 | 2.4624e-143 | 0.267784 | 0.152747 | 1615 | 2108 | 1254 | 281.17 |
| DxxF | ChhH | 139.7 | 79.7 | 1183.9 | 6.957811 | 2.6034e-12 | 0.118 | 0.067327 | 157 | 188 | 138 | 23.423 |
| RLxxE | HHhhH | 117.9 | 67.3 | 1249.5 | 6.341766 | 1.7026e-10 | 0.094358 | 0.053858 | 128 | 142 | 117 | 14.013 |
| RxxR | HhhC | 223.6 | 127.7 | 881.5 | 9.180571 | 3.3400e-20 | 0.253659 | 0.144835 | 266 | 300 | 208 | 46.926 |
| TxY | EeE | 525.3 | 300 | 3697 | 13.5691 | 4.6027e-42 | 0.142088 | 0.08115 | 562 | 610 | 309 | 124.673 |
| DxxxD | HhhhH | 761.9 | 435.3 | 3587 | 16.6982 | 1.0362e-62 | 0.212406 | 0.121362 | 755 | 883 | 574 | 158.083 |
| AxxxP | HhhhH | 152 | 86.9 | 915.3 | 7.34463 | 1.5470e-13 | 0.166006 | 0.094898 | 161 | 180 | 135 | 29.146 |
| RxxxxG | EeeecC | 117.9 | 67.4 | 1073 | 6.357254 | 1.5436e-10 | 0.109879 | 0.062797 | 126 | 132 | 93 | 30.807 |
| NxxxE | HhhhH | 854.2 | 488.3 | 4085.1 | 17.64964 | 7.8447e-70 | 0.209101 | 0.11952 | 856 | 1033 | 697 | 158.379 |
| QxxxG | HhhhH | 228.4 | 130.7 | 1785 | 8.871047 | 5.4425e-19 | 0.127955 | 0.073249 | 248 | 274 | 196 | 42.146 |
| PxS | ChH | 359.8 | 206 | 1492.8 | 11.54334 | 6.1661e-31 | 0.241024 | 0.137984 | 381 | 461 | 317 | 54.501 |
| NxxR | ChhH | 186.9 | 107 | 849.5 | 8.259216 | 1.1290e-16 | 0.220012 | 0.125961 | 200 | 233 | 166 | 47.681 |
| PxxK | HhhC | 134.8 | 77.3 | 516.7 | 7.0997 | 9.7499e-13 | 0.260886 | 0.149511 | 156 | 183 | 123 | 25.326 |
| YxxE | HhhH | 584.6 | 335.1 | 3516.7 | 14.33068 | 1.0637e-46 | 0.166235 | 0.095283 | 614 | 727 | 494 | 119.936 |
| SxEE | ChHH | 251.6 | 144.3 | 1525.5 | 9.392189 | 4.4475e-21 | 0.16493 | 0.094565 | 287 | 329 | 244 | 45.032 |
| QY | HC | 142.8 | 81.9 | 492.7 | 7.372573 | 1.3154e-13 | 0.289832 | 0.16619 | 166 | 192 | 141 | 28.461 |
| GxxA | ChhH | 294.2 | 168.8 | 2531.8 | 9.988638 | 1.2761e-23 | 0.116202 | 0.066679 | 325 | 356 | 261 | 83.468 |
| YxR | HcC | 106.8 | 61.3 | 540.1 | 6.174179 | 5.0968e-10 | 0.197741 | 0.113477 | 114 | 128 | 81 | 23.631 |
| RH | HC | 196.1 | 112.6 | 557.9 | 8.813158 | 9.7271e-19 | 0.351497 | 0.201757 | 209 | 257 | 138 | 31.879 |
| RxE | ChH | 511.7 | 293.9 | 1726.9 | 13.94985 | 2.4681e-44 | 0.296311 | 0.170167 | 497 | 646 | 363 | 89.812 |
| SxxQ | HhhH | 668.9 | 384.6 | 3261.9 | 15.4344 | 7.3145e-54 | 0.205065 | 0.117911 | 667 | 809 | 547 | 128.299 |
| NxxxE | CchhH | 153.6 | 88.3 | 790.2 | 7.369784 | 1.3030e-13 | 0.194381 | 0.111774 | 156 | 207 | 126 | 35.628 |
| RxxG | HhhC | 641.9 | 369.4 | 2583 | 15.31326 | 4.8017e-53 | 0.248509 | 0.143024 | 699 | 815 | 577 | 129.416 |
| ERxxA | HHhhH | 126.2 | 72.6 | 932.1 | 6.543421 | 4.5159e-11 | 0.135393 | 0.077938 | 150 | 159 | 133 | 14.687 |
| DxxD | ChhH | 374.5 | 215.7 | 1824.1 | 11.51857 | 8.0950e-31 | 0.205307 | 0.118228 | 400 | 447 | 317 | 54.562 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| RxE | EeE | 590.6 | 340.3 | 2432.2 | 14.6314 | 1.3602e−48 | 0.242825 | 0.13991 | 596 | 705 | 466 | 91.584 |
| TxxxE | HhhhH | 774.7 | 446.4 | 4237.2 | 16.42699 | 9.2564e−61 | 0.182833 | 0.105356 | 784 | 932 | 643 | 131.967 |
| FxF | EeE | 150.5 | 86.7 | 3210.8 | 6.941401 | 2.8496e−12 | 0.046873 | 0.027013 | 158 | 163 | 119 | 61.3 |
| DxxxY | HhhhH | 276.7 | 159.5 | 2217.1 | 9.632198 | 4.3574e−22 | 0.124803 | 0.071944 | 302 | 341 | 247 | 76.638 |
| KxxxL | HhhhC | 140.2 | 80.9 | 780.1 | 6.969798 | 2.4051e−12 | 0.179721 | 0.103656 | 176 | 196 | 150 | 17.239 |
| TPG | CCC | 165 | 95.3 | 927.3 | 7.54283 | 3.4767e−14 | 0.177936 | 0.102732 | 177 | 222 | 121 | 37.415 |
| GxxxD | HhhhH | 284.4 | 164.2 | 1944.5 | 9.799636 | 8.4522e−23 | 0.146259 | 0.084461 | 311 | 360 | 263 | 52.673 |
| AxxEE | HhhHH | 123.6 | 71.4 | 897.5 | 6.441339 | 8.8743e−11 | 0.137716 | 0.079539 | 128 | 153 | 110 | 24.386 |
| PxQ | ChH | 131.4 | 75.9 | 551.3 | 6.858192 | 5.3635e−12 | 0.238346 | 0.137697 | 138 | 175 | 114 | 22.393 |
| RxxxP | HhhcC | 272.2 | 157.3 | 1341.2 | 9.751274 | 1.3823e−22 | 0.202953 | 0.117281 | 294 | 324 | 246 | 46.055 |
| AxxxF | HhhhH | 315.3 | 182.3 | 6139.6 | 10.00393 | 1.0699e−23 | 0.051355 | 0.029686 | 326 | 365 | 264 | 134.406 |
| SxxxG | HhhhH | 213.3 | 123.3 | 2125.3 | 8.349052 | 5.0903e−17 | 0.100362 | 0.058023 | 225 | 260 | 192 | 62.971 |
| DxxQ | ChhH | 408.5 | 236.2 | 1714.9 | 12.0727 | 1.1263e−33 | 0.238206 | 0.137738 | 428 | 518 | 344 | 49.274 |
| WxxS | HhhH | 124.5 | 72 | 1245.8 | 6.374403 | 1.3622e−10 | 0.100016 | 0.05784 | 141 | 157 | 99 | 38.938 |
| GxxxQ | HhhhH | 268.1 | 155.1 | 2029.7 | 9.443637 | 2.6804e−21 | 0.132088 | 0.076405 | 287 | 315 | 235 | 38.085 |
| RxxxR | HhhcC | 156.4 | 90.5 | 685.1 | 7.43411 | 8.0526e−14 | 0.228288 | 0.132114 | 188 | 216 | 156 | 31.425 |
| RxxEA | HhhHH | 116.5 | 67.4 | 1018.4 | 6.184135 | 4.6459e−10 | 0.114395 | 0.066211 | 131 | 144 | 117 | 17.344 |
| SxG | HcC | 511.7 | 296.4 | 2101.8 | 13.49625 | 1.2581e−41 | 0.243458 | 0.141004 | 562 | 662 | 462 | 69.467 |
| GxxxQ | ChhH | 116.1 | 67.2 | 821.3 | 6.217114 | 3.7900e−10 | 0.141361 | 0.08188 | 131 | 151 | 94 | 20.811 |
| SxxL | ChhH | 205.4 | 119 | 1921 | 8.180858 | 2.0848e−16 | 0.106923 | 0.061934 | 227 | 253 | 190 | 40.531 |
| HxxxS | HhhhH | 162.3 | 94 | 1134.4 | 7.35248 | 1.4535e−13 | 0.143071 | 0.082885 | 190 | 209 | 164 | 37.756 |
| ExxxL | HhhhC | 161.1 | 93.4 | 989.5 | 7.354304 | 1.4394e−13 | 0.162809 | 0.094439 | 204 | 217 | 169 | 28.44 |
| ExxxL | HhhcC | 201.6 | 117 | 1358 | 8.183729 | 2.0534e−16 | 0.148454 | 0.086144 | 245 | 275 | 222 | 28.455 |
| YxP | CcH | 138.4 | 80.3 | 819.9 | 6.821998 | 6.7461e−12 | 0.168801 | 0.097974 | 164 | 177 | 116 | 35.479 |
| VDK | EEE | 120.2 | 69.8 | 507.1 | 6.498036 | 6.2314e−11 | 0.237034 | 0.137624 | 136 | 56 | 15 | 13.141 |
| SxxY | HhhH | 260.7 | 151.4 | 2441.4 | 9.174522 | 3.3449e−20 | 0.106783 | 0.062004 | 242 | 283 | 180 | 72.807 |
| DxxY | HhhH | 368.3 | 213.9 | 2333.5 | 11.07501 | 1.2369e−28 | 0.157832 | 0.091673 | 388 | 427 | 293 | 84.209 |
| LxV | CcH | 121.5 | 70.6 | 934.1 | 6.301937 | 2.1873e−10 | 0.130072 | 0.075572 | 137 | 149 | 116 | 30.831 |
| PxY | CeE | 141.4 | 82.2 | 1016.8 | 6.814641 | 7.0386e−12 | 0.139064 | 0.080816 | 149 | 174 | 119 | 29.862 |
| ExxxV | HhhhH | 640.3 | 372.2 | 5604 | 14.38506 | 4.7306e−47 | 0.114258 | 0.06641 | 656 | 754 | 552 | 112.908 |
| GxG | HcC | 179.1 | 104.3 | 868.7 | 7.813594 | 4.2001e−15 | 0.20617 | 0.120016 | 192 | 224 | 167 | 44.519 |
| DxxxG | HhhhC | 155.8 | 90.7 | 892.9 | 7.208474 | 4.2423e−13 | 0.174488 | 0.101604 | 181 | 201 | 138 | 20.459 |
| SxG | ChH | 214 | 124.8 | 1455.8 | 8.356712 | 4.7893e−17 | 0.146998 | 0.085692 | 217 | 266 | 170 | 52.458 |
| FxxxG | EcccC | 124.7 | 72.7 | 1449.8 | 6.254867 | 2.9197e−10 | 0.086012 | 0.050157 | 134 | 148 | 103 | 22.432 |
| YxE | EeC | 112 | 65.3 | 580.6 | 6.12772 | 6.7195e−10 | 0.192904 | 0.112536 | 130 | 151 | 102 | 22.006 |
| KxxxN | HhhhH | 655.3 | 382.3 | 3149.4 | 14.8929 | 2.7551e−50 | 0.208071 | 0.121401 | 667 | 805 | 560 | 144.066 |
| NxxxxK | ChhhhH | 173.5 | 101.2 | 1409.7 | 7.454423 | 6.6649e−14 | 0.123076 | 0.071816 | 213 | 230 | 180 | 31.027 |
| RxxxA | HhhhH | 1371.7 | 800.6 | 8918.1 | 21.15731 | 1.7498e−99 | 0.153811 | 0.089769 | 1345 | 1655 | 1122 | 268.179 |
| QxxN | HhhH | 542.7 | 316.8 | 2555 | 13.56124 | 5.1153e−42 | 0.212407 | 0.123988 | 528 | 641 | 407 | 81.716 |
| EExxA | HHhhH | 231.4 | 135.1 | 1569.7 | 8.663887 | 3.3802e−18 | 0.147417 | 0.086081 | 272 | 284 | 230 | 31.482 |
| ExxxD | HhhhH | 1027.9 | 600.3 | 4905.2 | 18.63074 | 1.3593e−77 | 0.209553 | 0.122376 | 1027 | 1223 | 838 | 210.884 |
| NxxQ | HhhH | 424.5 | 248 | 2082.1 | 11.94525 | 5.1603e−33 | 0.203881 | 0.11909 | 450 | 514 | 343 | 83.71 |
| LxxxD | HhhhH | 439.7 | 256.8 | 3658.5 | 11.83281 | 1.9411e−32 | 0.120186 | 0.070204 | 493 | 552 | 428 | 61.228 |
| AxxxT | HhhhH | 535.6 | 313 | 5359.1 | 12.96648 | 1.3850e−38 | 0.099942 | 0.058405 | 566 | 667 | 467 | 119.61 |
| NxxxV | HhhhH | 198.5 | 116 | 2149.2 | 7.870098 | 2.5918e−15 | 0.09236 | 0.053993 | 214 | 241 | 168 | 42.296 |
| AxG | HcC | 1022.2 | 597.7 | 4368 | 18.6919 | 4.3518e−78 | 0.23402 | 0.136825 | 1093 | 1343 | 884 | 165.19 |
| SxxxD | HhhhH | 542.1 | 317.1 | 2830.2 | 13.40801 | 4.0538e−41 | 0.191541 | 0.112045 | 577 | 678 | 474 | 109.938 |
| NxxS | HhhC | 143.9 | 84.2 | 634.7 | 6.988096 | 2.1104e−12 | 0.226721 | 0.132639 | 163 | 170 | 84 | 15.696 |
| LxxxS | HhhhH | 425.1 | 248.9 | 5887 | 11.41524 | 2.5453e−30 | 0.07221 | 0.042274 | 453 | 514 | 374 | 80.723 |
| DxxH | ChhH | 119.9 | 70.3 | 580.8 | 6.31013 | 2.0985e−10 | 0.206439 | 0.121037 | 148 | 156 | 136 | 27.653 |
| GxxE | ChhH | 439 | 257.5 | 2293 | 12.00864 | 2.3858e−33 | 0.191452 | 0.112072 | 458 | 557 | 364 | 100.014 |
| SxxR | HhhH | 897.4 | 526.5 | 4584.1 | 17.18044 | 2.7728e−66 | 0.195764 | 0.114856 | 903 | 1089 | 733 | 182.489 |
| TxE | ChH | 1585.3 | 930.3 | 5513.1 | 23.55417 | 8.6926e−123 | 0.287551 | 0.168742 | 1546 | 2023 | 1133 | 224.257 |
| RxxQ | HhhC | 134.4 | 78.9 | 541.4 | 6.75969 | 1.0508e−11 | 0.248245 | 0.145739 | 156 | 175 | 137 | 24.893 |
| DxxG | ChhH | 206.7 | 121.6 | 1369.1 | 8.085262 | 4.5748e−16 | 0.150975 | 0.088814 | 241 | 271 | 193 | 44.741 |
| NxG | HhC | 207.9 | 122.3 | 887 | 8.331963 | 5.9917e−17 | 0.234386 | 0.13792 | 233 | 274 | 207 | 47.58 |
| ExxxP | HhhhH | 235.1 | 138.4 | 1108 | 8.792455 | 1.0954e−18 | 0.212184 | 0.124867 | 248 | 300 | 213 | 46.018 |
| ExR | HcC | 208.6 | 122.8 | 704.9 | 8.523866 | 1.1834e−17 | 0.295929 | 0.174169 | 231 | 270 | 195 | 25.86 |
| ExxxS | HhhhC | 285.9 | 168.3 | 1380.3 | 9.676894 | 2.8236e−22 | 0.207129 | 0.12191 | 348 | 362 | 277 | 39.886 |
| TxxN | ChhH | 136.8 | 80.6 | 770.4 | 6.622398 | 2.6275e−11 | 0.17757 | 0.104563 | 153 | 183 | 121 | 29.388 |
| RY | HC | 179.4 | 105.7 | 690.9 | 7.786927 | 5.2074e−15 | 0.259661 | 0.153012 | 192 | 229 | 157 | 45.361 |
| PxD | ChH | 394.7 | 232.9 | 1487.4 | 11.54793 | 5.7222e−31 | 0.265362 | 0.156556 | 405 | 495 | 316 | 70.962 |
| RxxR | HhhH | 1439.9 | 849.7 | 5869.7 | 21.89206 | 2.3219e−106 | 0.245311 | 0.144767 | 1337 | 1670 | 1062 | 351.183 |
| PxxE | ChhH | 403.9 | 238.4 | 1641.8 | 11.59111 | 3.4386e−31 | 0.24601 | 0.145223 | 439 | 526 | 367 | 84.553 |
| RxxxS | HhhhC | 140 | 82.7 | 696.5 | 6.718848 | 1.3667e−11 | 0.201005 | 0.118672 | 163 | 195 | 149 | 22.729 |
| GxxN | ChhH | 131.3 | 77.5 | 799 | 6.424651 | 9.7711e−11 | 0.16433 | 0.097048 | 148 | 159 | 119 | 31.848 |
| RxxxQ | HhhcC | 115 | 67.9 | 528.4 | 6.119902 | 7.0248e−10 | 0.217638 | 0.128534 | 143 | 161 | 101 | 18.483 |
| TxxxT | HhhhH | 302.7 | 178.8 | 2535 | 9.61163 | 5.2002e−22 | 0.119408 | 0.07053 | 322 | 356 | 271 | 57.629 |
| YxxS | HhhH | 346.5 | 204.8 | 2705.9 | 10.30319 | 4.9701e−25 | 0.128054 | 0.07567 | 407 | 448 | 323 | 85.864 |
| ExxxA | HhhhH | 2448.2 | 1446.9 | 14973 | 27.6968 | 5.5984e−169 | 0.163508 | 0.096632 | 2360 | 2967 | 1770 | 391.906 |
| NY | HC | 149.3 | 88.3 | 580 | 7.051042 | 1.3429e−12 | 0.257414 | 0.152234 | 152 | 175 | 108 | 37.209 |
| LxxQ | HhhH | 1044.9 | 618.7 | 8365.8 | 17.80356 | 4.8141e−71 | 0.124901 | 0.07396 | 1054 | 1237 | 839 | 205.342 |
| RxF | EeE | 260.1 | 154 | 2165 | 8.868217 | 5.4042e−19 | 0.120139 | 0.071144 | 273 | 304 | 219 | 68.858 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| GxxxT | HhhhH | 198.8 | 117.8 | 2285 | 7.668973 | 1.2522e−14 | 0.087002 | 0.051533 | 220 | 254 | 188 | 44.775 |
| DxS | CcH | 196.1 | 116.2 | 853.5 | 7.979762 | 1.0971e−15 | 0.22976 | 0.136101 | 207 | 261 | 165 | 29.246 |
| ExxxT | HhhcC | 171.6 | 101.7 | 869.5 | 7.378634 | 1.1868e−13 | 0.197355 | 0.116943 | 190 | 219 | 164 | 33.207 |
| SxxxY | HhhhH | 187.1 | 110.9 | 2109.6 | 7.437346 | 7.4213e−14 | 0.08869 | 0.052556 | 221 | 241 | 180 | 52.01 |
| RxxxT | HhhhH | 529 | 313.5 | 3140.6 | 12.82735 | 8.4563e−38 | 0.168439 | 0.099825 | 562 | 637 | 427 | 124.852 |
| RxxxG | EcccC | 306.9 | 181.9 | 1622.6 | 9.832716 | 6.0107e−23 | 0.189141 | 0.112123 | 321 | 376 | 245 | 70.592 |
| LxxxT | HhhhH | 391.1 | 231.9 | 5672.7 | 10.6763 | 9.4215e−27 | 0.068944 | 0.040877 | 411 | 468 | 353 | 70.436 |
| DxxxT | HhhhH | 510.9 | 302.9 | 3002.8 | 12.59994 | 1.5506e−36 | 0.170141 | 0.100889 | 520 | 632 | 440 | 81.259 |
| AxxxS | HhhhC | 167.8 | 99.5 | 1431 | 7.09616 | 9.3266e−13 | 0.117261 | 0.069543 | 206 | 230 | 172 | 23.643 |
| TxN | ChH | 178.1 | 105.6 | 773 | 7.587086 | 2.4467e−14 | 0.230401 | 0.136666 | 187 | 207 | 125 | 44.663 |
| DxxxH | HhhhH | 249.3 | 147.9 | 1441.7 | 8.798561 | 1.0190e−18 | 0.172921 | 0.102605 | 269 | 312 | 243 | 55.987 |
| PxxxA | CchhH | 156.9 | 93.1 | 1242.7 | 6.870682 | 4.6541e−12 | 0.126257 | 0.074941 | 179 | 191 | 130 | 30.164 |
| ExxQ | ChhH | 130.4 | 77.4 | 549 | 6.499866 | 6.0311e−11 | 0.237523 | 0.140984 | 148 | 174 | 121 | 22.094 |
| DxR | EeE | 241.4 | 143.3 | 1105.4 | 8.782154 | 1.1928e−18 | 0.218382 | 0.129651 | 241 | 273 | 175 | 55.856 |
| VxxxG | HhhhC | 156.3 | 92.9 | 1639 | 6.779043 | 8.7424e−12 | 0.095363 | 0.056653 | 194 | 215 | 174 | 26.154 |
| AxxxE | HhhhH | 1813.4 | 1077.4 | 10751.7 | 23.6388 | 1.1253e−123 | 0.168662 | 0.100207 | 1799 | 2218 | 1404 | 311.318 |
| DxxL | ChhH | 415.6 | 247 | 2867.7 | 11.22142 | 2.3305e−29 | 0.144925 | 0.086134 | 474 | 521 | 401 | 85.252 |
| ExxxG | HhhhC | 343.9 | 204.4 | 1996.9 | 10.29927 | 5.2066e−25 | 0.172217 | 0.102356 | 401 | 457 | 326 | 66.121 |
| SxxR | ChhH | 182.9 | 108.7 | 943.8 | 7.562349 | 2.9256e−14 | 0.193791 | 0.115201 | 190 | 221 | 174 | 40.459 |
| YxxR | HhhH | 419.1 | 249.3 | 2896.8 | 11.25098 | 1.6663e−29 | 0.144677 | 0.086053 | 445 | 505 | 368 | 95.767 |
| MxxxA | HhhhH | 219.1 | 130.3 | 4056.4 | 7.9041 | 1.9271e−15 | 0.054013 | 0.032129 | 233 | 243 | 178 | 49.827 |
| KxxxQ | HhhhH | 1012.1 | 602.6 | 4794.5 | 17.86682 | 1.5795e−71 | 0.211221 | 0.125865 | 1071 | 1266 | 813 | 210.211 |
| LxP | CcH | 462.1 | 275 | 3282.8 | 11.78653 | 3.3267e−32 | 0.140764 | 0.083772 | 517 | 589 | 393 | 66.229 |
| NxQ | CcE | 241.5 | 143.8 | 921.8 | 8.867344 | 5.6237e−19 | 0.261987 | 0.156009 | 246 | 295 | 178 | 38.902 |
| KxxxY | HhhhH | 398 | 237.1 | 2680.3 | 10.94733 | 4.9780e−28 | 0.148491 | 0.088449 | 422 | 490 | 362 | 82.687 |
| AExxA | HHHhH | 177.1 | 105.6 | 2016 | 7.14469 | 6.4810e−13 | 0.087847 | 0.052392 | 206 | 232 | 184 | 27.754 |
| QxP | HcC | 209.1 | 124.7 | 802.5 | 8.222219 | 1.4978e−16 | 0.260561 | 0.155407 | 224 | 278 | 195 | 37.428 |
| SLP | CCC | 173.3 | 103.4 | 1051.9 | 7.242306 | 3.2273e−13 | 0.16475 | 0.098276 | 192 | 223 | 157 | 33.474 |
| FxP | CcH | 163.8 | 97.7 | 1281.6 | 6.955237 | 2.5528e−12 | 0.127809 | 0.076247 | 187 | 207 | 154 | 26.16 |
| PxxxE | HhhhH | 874.9 | 522 | 4147.7 | 16.51668 | 2.0506e−61 | 0.210912 | 0.12585 | 902 | 1091 | 727 | 146.13 |
| DxF | ChH | 126.5 | 75.5 | 775.9 | 6.175381 | 4.8333e−10 | 0.163076 | 0.097325 | 138 | 154 | 118 | 25.97 |
| DxR | EcC | 177.6 | 106.1 | 973.9 | 7.352718 | 1.4250e−13 | 0.18236 | 0.10895 | 180 | 199 | 138 | 42.006 |
| YxxG | EecC | 245.6 | 146.8 | 1707.4 | 8.533428 | 1.0309e−17 | 0.143844 | 0.085957 | 256 | 293 | 188 | 44.484 |
| ExxxQ | HhhhC | 184.1 | 110.1 | 858.5 | 7.555177 | 3.0917e−14 | 0.214444 | 0.128231 | 227 | 256 | 207 | 21.363 |
| ExxR | HhcC | 256.7 | 153.6 | 992.7 | 9.051119 | 1.0566e−19 | 0.258588 | 0.154704 | 298 | 340 | 220 | 47.105 |
| SxxD | ChhH | 740.5 | 443 | 3728.2 | 15.05505 | 2.3442e−51 | 0.198621 | 0.118834 | 773 | 907 | 609 | 152.565 |
| RxxxS | HhhhH | 610.4 | 365.3 | 3531.9 | 13.54145 | 6.4805e−42 | 0.172825 | 0.103436 | 651 | 743 | 536 | 147.715 |
| VPG | CCC | 166.4 | 99.6 | 1134.4 | 7.006024 | 1.7808e−12 | 0.146685 | 0.087813 | 192 | 224 | 166 | 28.485 |
| KxxxE | CchhH | 374.5 | 224.2 | 1690.2 | 10.77748 | 3.2446e−27 | 0.221571 | 0.132651 | 395 | 458 | 302 | 76.148 |
| CS | HH | 163.9 | 98.2 | 1268 | 6.908564 | 3.5402e−12 | 0.129259 | 0.077411 | 171 | 185 | 97 | 46.169 |
| DxN | ChH | 418.4 | 250.6 | 1597.8 | 11.54559 | 5.7935e−31 | 0.26186 | 0.156827 | 433 | 521 | 349 | 57.653 |
| AxxR | HhhH | 1961.9 | 1175.2 | 11570.1 | 24.20913 | 1.2946e−129 | 0.169566 | 0.101576 | 1808 | 2329 | 1411 | 364.394 |
| FxxS | HhhH | 256.5 | 153.7 | 2817.2 | 8.532759 | 1.0219e−17 | 0.091048 | 0.054542 | 286 | 316 | 239 | 65.283 |
| QxxG | HhcC | 372.1 | 222.9 | 1610.9 | 10.76288 | 3.8093e−27 | 0.230989 | 0.138391 | 426 | 493 | 371 | 65.685 |
| HxxE | HhhH | 473.2 | 283.5 | 2266.1 | 12.04328 | 1.5453e−33 | 0.208817 | 0.125115 | 484 | 591 | 400 | 98.106 |
| ExxG | HhhC | 927.7 | 556.2 | 3737.1 | 17.07683 | 1.6364e−65 | 0.248241 | 0.148819 | 1016 | 1234 | 849 | 159.494 |
| TxxxH | HhhhH | 158.4 | 95 | 1225.2 | 6.777905 | 8.8108e−12 | 0.129263 | 0.077507 | 185 | 197 | 158 | 38.052 |
| LxxxD | CchhH | 251 | 150.3 | 3175.1 | 8.394641 | 3.3309e−17 | 0.079053 | 0.047397 | 284 | 311 | 232 | 49.522 |
| AxxxH | HhhhH | 353 | 211.8 | 3069.1 | 10.05093 | 6.5266e−24 | 0.115017 | 0.069026 | 373 | 426 | 305 | 99.698 |
| DxxxV | HhhhH | 310.1 | 186.2 | 3011.7 | 9.379048 | 4.7618e−21 | 0.102965 | 0.06181 | 318 | 357 | 260 | 55.713 |
| KxxxH | HhhhH | 282.8 | 169.8 | 1521 | 9.202981 | 2.5409e−20 | 0.18593 | 0.111622 | 301 | 362 | 241 | 94.486 |
| SxxxQ | ChhhH | 160.3 | 96.2 | 1237.6 | 6.799777 | 7.5620e−12 | 0.129525 | 0.077763 | 181 | 204 | 150 | 36.116 |
| QxxxA | HhhhC | 135.6 | 81.5 | 743.3 | 6.355858 | 1.5158e−10 | 0.18243 | 0.109602 | 174 | 199 | 154 | 22.04 |
| KxxxD | HhhhH | 1559.9 | 937.5 | 7193.2 | 21.79635 | 1.8415e−105 | 0.216858 | 0.130335 | 1513 | 2010 | 1131 | 232.776 |
| QxxI | HhhH | 566.2 | 340.5 | 4971.5 | 12.67152 | 6.0800e−37 | 0.113889 | 0.068494 | 599 | 676 | 469 | 89.516 |
| ExxxxP | HhcccC | 160.6 | 96.6 | 1356.6 | 6.758251 | 1.0039e−11 | 0.118384 | 0.071199 | 205 | 218 | 173 | 30.38 |
| YxS | EeE | 207.4 | 124.8 | 2356 | 7.603442 | 2.0554e−14 | 0.088031 | 0.052952 | 226 | 241 | 161 | 57.467 |
| RxxEE | HhhHH | 141 | 84.8 | 971.6 | 6.385644 | 1.2352e−10 | 0.145121 | 0.087296 | 162 | 180 | 143 | 26.819 |
| KxxxE | HhhhC | 340.5 | 204.9 | 1480.5 | 10.20524 | 1.3831e−24 | 0.22999 | 0.138401 | 402 | 482 | 329 | 38.586 |
| DxxH | HhhH | 278.9 | 167.8 | 1432.4 | 9.123795 | 5.2948e−20 | 0.194708 | 0.117174 | 316 | 366 | 268 | 57.292 |
| PxxN | HhhH | 169.2 | 101.9 | 934.3 | 7.064647 | 1.1733e−12 | 0.181098 | 0.109055 | 180 | 215 | 142 | 19.912 |
| DxxR | ChhH | 424.4 | 255.7 | 1831.5 | 11.37574 | 4.0622e−30 | 0.231723 | 0.1396 | 442 | 539 | 373 | 86.94 |
| ExxxT | HhhhH | 863.4 | 520.4 | 5003.9 | 15.88451 | 5.8664e−57 | 0.172545 | 0.103999 | 893 | 1035 | 747 | 128.695 |
| PxxQ | HhhH | 457.1 | 275.6 | 2183.2 | 11.69472 | 9.9071e−32 | 0.209372 | 0.126244 | 485 | 582 | 395 | 66.605 |
| RxR | CcE | 174.4 | 105.2 | 662.2 | 7.360225 | 1.3652e−13 | 0.263365 | 0.158821 | 171 | 202 | 137 | 45.897 |
| AxxxM | HhhhH | 216.2 | 130.4 | 4230.4 | 7.627727 | 1.6849e−14 | 0.051106 | 0.030833 | 247 | 277 | 216 | 51.702 |
| TxR | ChH | 214.3 | 129.3 | 922.7 | 8.061588 | 5.5443e−16 | 0.232253 | 0.140129 | 214 | 260 | 170 | 46.253 |
| KxxxN | HhhhC | 184.1 | 111.1 | 842.5 | 7.431858 | 7.8583e−14 | 0.218516 | 0.131881 | 221 | 255 | 175 | 34.005 |
| NxG | EcC | 266.8 | 161.1 | 1531.2 | 8.80872 | 9.1688e−19 | 0.174242 | 0.105181 | 275 | 305 | 146 | 82.701 |
| RxxD | ChhH | 233.9 | 141.2 | 1264 | 8.276139 | 9.2445e−17 | 0.185047 | 0.111716 | 254 | 322 | 222 | 38.672 |
| KxxxM | HhhhH | 288.8 | 174.5 | 2042.3 | 9.05073 | 1.0196e−19 | 0.141409 | 0.085429 | 306 | 360 | 253 | 62.497 |
| SxxxxL | ChhhhH | 176.2 | 106.5 | 2832.5 | 6.880847 | 4.2026e−12 | 0.062207 | 0.03761 | 209 | 220 | 186 | 45.913 |
| ExxAR | HhhHH | 162.3 | 98.2 | 1479.8 | 6.699894 | 1.4889e−11 | 0.109677 | 0.066333 | 184 | 208 | 161 | 27.669 |

TABLE 36-continued (Table 36, in its entirety, discloses SEQ ID NOS 3,187-5,226, respectively, in order of appearance)

| Sequence | Structure | In Epitopes | Expected In Epi | In PDB | Z-Score | P-Value Upper | Observed Ratio | Null Probability | Num Crystal Sets | Num Interface Intersets | Num Chainsets 25 | Non-Water Solvent |
|---|---|---|---|---|---|---|---|---|---|---|---|---|
| QxD | ChH | 147.6 | 89.4 | 587.1 | 6.689422 | 1.6561e−11 | 0.251405 | 0.152227 | 151 | 172 | 107 | 36.91 |
| TxEE | ChHH | 243.4 | 147.4 | 1546.4 | 8.314461 | 6.6330e−17 | 0.157398 | 0.095312 | 283 | 303 | 226 | 41.814 |
| TxxxL | HhhhH | 483.5 | 292.8 | 8858.3 | 11.33044 | 6.5072e−30 | 0.054582 | 0.033058 | 520 | 621 | 429 | 125.095 |
| ExxxM | HhhhH | 403.4 | 244.3 | 3338.3 | 10.57111 | 2.8892e−26 | 0.12084 | 0.073189 | 443 | 500 | 359 | 67.95 |
| MxxxL | HhhhH | 227.6 | 137.9 | 5514.6 | 7.738694 | 7.0433e−15 | 0.041272 | 0.025002 | 267 | 288 | 224 | 56.394 |
| YxxD | HhhH | 309.6 | 187.6 | 1936.7 | 9.372461 | 5.0951e−21 | 0.15986 | 0.096867 | 326 | 376 | 282 | 53.375 |
| KY | HC | 311.9 | 189.1 | 1051.9 | 9.856121 | 4.8051e−23 | 0.296511 | 0.179808 | 330 | 402 | 272 | 38.686 |
| RxP | HcC | 272.6 | 165.4 | 1046.7 | 9.080465 | 7.9710e−20 | 0.260438 | 0.158052 | 304 | 346 | 264 | 43.163 |
| GLP | CCC | 279.5 | 169.6 | 1833.1 | 8.854745 | 6.0139e−19 | 0.152474 | 0.092541 | 296 | 355 | 249 | 50.76 |
| SxxxT | HhhhH | 386.1 | 234.4 | 2954.6 | 10.3294 | 3.6971e−25 | 0.130678 | 0.079323 | 398 | 462 | 317 | 75.756 |
| TxS | ChH | 302.5 | 183.7 | 1336.5 | 9.440319 | 2.7128e−21 | 0.226337 | 0.13743 | 310 | 375 | 236 | 52.207 |
| NxE | ChH | 840.2 | 510.2 | 3189.6 | 15.94033 | 2.4469e−57 | 0.263419 | 0.159957 | 852 | 1054 | 677 | 130.26 |
| DxxE | ChhH | 635.3 | 386.1 | 2788.7 | 13.66215 | 1.2445e−42 | 0.227812 | 0.138458 | 672 | 790 | 548 | 102.326 |
| QxxxV | HhhhH | 290.2 | 176.4 | 3024.7 | 8.829936 | 7.4024e−19 | 0.095943 | 0.058319 | 316 | 371 | 260 | 85.71 |
| GxV | CcH | 142.7 | 86.8 | 982.2 | 6.289195 | 2.2883e−10 | 0.145286 | 0.088337 | 147 | 166 | 125 | 31.929 |
| PxA | ChH | 300.2 | 182.7 | 1377.9 | 9.335371 | 7.3154e−21 | 0.217868 | 0.132582 | 316 | 363 | 256 | 49.987 |
| RxxQ | HhhH | 1120.7 | 683.5 | 5021.1 | 17.99374 | 1.5808e−72 | 0.223198 | 0.13612 | 1094 | 1312 | 857 | 202.148 |
| NxS | ChH | 286.4 | 174.8 | 1258.8 | 9.10101 | 6.5075e−20 | 0.227518 | 0.138825 | 303 | 357 | 250 | 54.56 |
| LPP | CCC | 180.4 | 110.2 | 1229.1 | 7.014972 | 1.6415e−12 | 0.146774 | 0.08962 | 178 | 217 | 156 | 21.42 |
| RxN | EeC | 190.4 | 116.3 | 798.3 | 7.437105 | 7.5124e−14 | 0.238507 | 0.145653 | 179 | 217 | 124 | 38.991 |
| IxxxK | HhhhH | 702.9 | 429.8 | 5778.4 | 13.69065 | 8.1501e−43 | 0.121643 | 0.074385 | 777 | 874 | 600 | 134.385 |
| QxxH | HhhH | 240 | 146.8 | 1371.3 | 8.139332 | 2.8477e−16 | 0.175016 | 0.107058 | 250 | 298 | 214 | 48.318 |
| RxQ | EeE | 235.1 | 143.8 | 1065.2 | 8.180894 | 2.0416e−16 | 0.22071 | 0.135042 | 232 | 277 | 172 | 39.053 |
| DxxxE | HhhhH | 1501.2 | 918.8 | 7072.8 | 20.59983 | 1.9838e−94 | 0.21225 | 0.129901 | 1488 | 1867 | 1173 | 279.838 |
| NxxxG | HhhhH | 155 | 94.9 | 1305.1 | 6.409783 | 1.0322e−10 | 0.118765 | 0.072698 | 175 | 191 | 155 | 33.083 |
| PxxG | HhhC | 153 | 93.7 | 807.5 | 6.509851 | 5.4137e−11 | 0.189474 | 0.11609 | 174 | 190 | 141 | 20.911 |
| DxxxA | HhhhH | 1305.7 | 800.2 | 8841.7 | 18.73718 | 1.7447e−78 | 0.147675 | 0.090505 | 1347 | 1647 | 1120 | 211.68 |
| LY | HC | 138.9 | 85.1 | 796.1 | 6.165963 | 5.0248e−10 | 0.174476 | 0.106941 | 152 | 170 | 121 | 14.864 |
| PxxL | ChhH | 222.4 | 136.4 | 2084.4 | 7.621642 | 1.7634e−14 | 0.106697 | 0.065419 | 243 | 272 | 201 | 46.144 |
| VxxxF | HhhhH | 171.5 | 105.2 | 4285.6 | 6.549046 | 4.0245e−11 | 0.040018 | 0.02454 | 169 | 218 | 145 | 84.989 |
| DxS | CcE | 237.4 | 145.6 | 1171.4 | 8.130164 | 3.0858e−16 | 0.202663 | 0.124293 | 257 | 272 | 162 | 29.903 |
| ExxLE | HhhHH | 164.2 | 100.8 | 1515.9 | 6.539672 | 4.3457e−11 | 0.108318 | 0.066476 | 182 | 196 | 160 | 35.833 |
| NxxP | HhcC | 135.6 | 83.2 | 655 | 6.145038 | 5.7748e−10 | 0.207023 | 0.127058 | 159 | 177 | 133 | 25.879 |
| QxG | HcC | 492.4 | 302.3 | 1853.5 | 11.95146 | 4.6538e−33 | 0.26566 | 0.163098 | 546 | 659 | 433 | 83.868 |
| AxxxL | HhccC | 142.7 | 87.6 | 1446 | 6.06968 | 9.0182e−10 | 0.098686 | 0.060602 | 188 | 204 | 166 | 29.997 |
| TxP | HcC | 196.8 | 121 | 877.5 | 7.425272 | 8.1367e−14 | 0.224274 | 0.137858 | 217 | 250 | 174 | 33.337 |
| ALP | CCC | 144.5 | 88.8 | 974.8 | 6.194927 | 4.1448e−10 | 0.148236 | 0.091132 | 150 | 179 | 129 | 30.435 |
| YxxG | HhcC | 182 | 111.9 | 1042.3 | 7.012416 | 1.6727e−12 | 0.174614 | 0.10737 | 183 | 215 | 149 | 52.14 |
| DxxT | ChhH | 458.2 | 282.2 | 2519.2 | 11.16131 | 4.4957e−29 | 0.182161 | 0.112025 | 479 | 585 | 405 | 89.773 |
| YxF | CcC | 231.3 | 142.3 | 1699 | 7.788873 | 4.7756e−15 | 0.136139 | 0.083784 | 249 | 268 | 173 | 83.115 |
| SxxA | ChhH | 337.5 | 207.7 | 2881.5 | 9.347949 | 6.2762e−21 | 0.117126 | 0.072087 | 377 | 424 | 299 | 84.421 |
| FxI | EeE | 196.6 | 121 | 5105.9 | 6.953154 | 2.4724e−12 | 0.038504 | 0.023702 | 213 | 219 | 156 | 66.504 |
| DxxN | ChhH | 214.2 | 132 | 1123.3 | 7.633654 | 1.6354e−14 | 0.190686 | 0.117519 | 239 | 297 | 184 | 64.208 |
| DxxA | ChhH | 593.4 | 365.5 | 3282 | 12.64821 | 8.1426e−37 | 0.180804 | 0.111354 | 630 | 744 | 513 | 75.148 |
| LxL | CcH | 176.2 | 108.5 | 1561.1 | 6.732965 | 1.1688e−11 | 0.112869 | 0.069526 | 189 | 207 | 155 | 35.143 |
| IxxxY | HhhhH | 164.9 | 101.6 | 3264 | 6.374812 | 1.2709e−10 | 0.050521 | 0.03114 | 176 | 198 | 154 | 46.701 |
| KxxG | HhcC | 867.2 | 534.5 | 3433.8 | 15.65894 | 2.0892e−55 | 0.252548 | 0.155669 | 924 | 1110 | 716 | 134.251 |
| FxS | EeE | 172.8 | 106.5 | 2333 | 6.571821 | 3.4634e−11 | 0.074068 | 0.045664 | 180 | 194 | 131 | 54.814 |
| QH | HC | 145.4 | 89.7 | 424 | 6.630426 | 2.4996e−11 | 0.342925 | 0.211441 | 164 | 184 | 139 | 29.8 |
| TxxxxE | ChhhhH | 224.8 | 138.7 | 1943.5 | 7.580991 | 2.4056e−14 | 0.115668 | 0.071391 | 268 | 281 | 217 | 37.067 |
| AxxKA | HhhhH | 166.5 | 102.8 | 1820.9 | 6.469686 | 8.8625e−11 | 0.091438 | 0.056648 | 206 | 240 | 174 | 25.798 |
| QxxQ | HhhH | 966 | 596.4 | 4465.5 | 16.25654 | 1.4369e−59 | 0.216325 | 0.133567 | 947 | 1146 | 759 | 157.719 |
| PxxxxR | HhhhhH | 238.9 | 147.5 | 2305.1 | 7.777629 | 5.1670e−15 | 0.10364 | 0.063993 | 272 | 286 | 215 | 41.213 |
| AxxxY | HhhhH | 328.5 | 202.9 | 5012.9 | 9.005726 | 1.4841e−19 | 0.065537 | 0.040471 | 339 | 400 | 304 | 88.415 |
| GxxG | HhhC | 171.9 | 106.2 | 1065.7 | 6.724762 | 1.2479e−11 | 0.161302 | 0.099611 | 215 | 221 | 165 | 33.951 |
| WxxR | HhhH | 186.9 | 115.5 | 1454.6 | 6.929554 | 2.9705e−12 | 0.128489 | 0.079374 | 197 | 238 | 151 | 72.73 |
| YxP | EcC | 223.8 | 138.3 | 1582.3 | 7.610135 | 1.9299e−14 | 0.14144 | 0.087407 | 250 | 288 | 204 | 54.263 |
| TxxxxK | ChhhH | 195.3 | 120.8 | 1644.2 | 7.037027 | 1.3767e−12 | 0.118781 | 0.073495 | 229 | 240 | 181 | 47.354 |
| SxL | HhC | 258 | 159.7 | 1828 | 8.14081 | 2.7616e−16 | 0.141138 | 0.087371 | 307 | 339 | 232 | 50.261 |
| FxY | CcC | 197.6 | 122.3 | 1387.8 | 7.126119 | 2.2715e−13 | 0.142384 | 0.088151 | 205 | 232 | 151 | 68.212 |
| PxA | CcH | 167.1 | 103.6 | 1215 | 6.528079 | 4.6873e−11 | 0.137531 | 0.085236 | 193 | 221 | 168 | 47.747 |
| ExxY | HhhH | 594.3 | 368.6 | 4092.2 | 12.32158 | 4.8612e−35 | 0.145228 | 0.090082 | 630 | 705 | 509 | 120.715 |
| EH | HC | 228.4 | 141.7 | 666.7 | 8.20849 | 1.6592e−16 | 0.342583 | 0.212529 | 233 | 279 | 202 | 42.365 |
| HxE | ChH | 196.5 | 121.9 | 874.7 | 7.277859 | 2.4319e−13 | 0.224648 | 0.139413 | 202 | 236 | 160 | 30.705 |
| SxV | ChH | 170.8 | 106 | 1130.6 | 6.610197 | 2.7051e−11 | 0.15107 | 0.093764 | 179 | 206 | 139 | 31.222 |
| FG | HC | 520.5 | 323.3 | 2395.3 | 11.79391 | 2.9912e−32 | 0.217301 | 0.134962 | 589 | 673 | 478 | 92.261 |
| PxE | ChH | 750.1 | 466 | 2940 | 14.34588 | 8.1316e−47 | 0.255136 | 0.158508 | 757 | 942 | 616 | 106.696 |
| YN | HC | 175.1 | 108.8 | 647.7 | 6.965652 | 2.3708e−12 | 0.270341 | 0.168011 | 195 | 225 | 138 | 30.624 |
| TxxG | HhcC | 231.4 | 144.2 | 1143.9 | 7.77065 | 5.5443e−15 | 0.20229 | 0.126037 | 253 | 305 | 199 | 42.592 |
| PGD | CCC | 199.2 | 124.2 | 1125.9 | 7.138468 | 6.6622e−13 | 0.176925 | 0.110285 | 217 | 252 | 156 | 38.178 |
| KxxxP | HhhcC | 278.6 | 173.7 | 1410.7 | 8.496381 | 1.3851e−17 | 0.197491 | 0.123154 | 307 | 370 | 236 | 49.368 |
| SxG | EeC | 176.7 | 110.2 | 1436.4 | 6.59101 | 3.0464e−11 | 0.123016 | 0.076729 | 189 | 214 | 121 | 62.904 |
| FxxE | HhhH | 477.3 | 297.7 | 4177.8 | 10.79934 | 2.4039e−27 | 0.114247 | 0.071263 | 503 | 577 | 429 | 90.405 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Probability | Num Crystal Sets | Num Interface Intersets | Num Chain-sets 25 | Non-Water Solvent |
|---|---|---|---|---|---|---|---|---|---|---|---|---|
| PGA | CCC | 212.4 | 132.7 | 1275.2 | 7.304192 | 1.9593e−13 | 0.166562 | 0.104098 | 240 | 269 | 170 | 62.409 |
| DxD | ChH | 676.9 | 423.4 | 2579 | 13.47793 | 1.5116e−41 | 0.262466 | 0.164158 | 678 | 857 | 564 | 112.944 |
| AxP | HcC | 365.8 | 228.9 | 1699.7 | 9.723656 | 1.6933e−22 | 0.215214 | 0.134695 | 409 | 472 | 349 | 60.063 |
| NxL | HhC | 178 | 111.4 | 1250.4 | 6.609312 | 2.6962e−11 | 0.142354 | 0.089105 | 216 | 254 | 182 | 29.912 |
| NxT | ChH | 211 | 132.2 | 967 | 7.375862 | 1.1589e−13 | 0.218201 | 0.136714 | 220 | 273 | 175 | 54.286 |
| RxxE | HhhH | 2176.8 | 1363.9 | 9113.5 | 23.87027 | 4.4302e−126 | 0.238854 | 0.149656 | 2059 | 2638 | 1645 | 369.823 |
| PLP | CCC | 188.1 | 117.9 | 1190.8 | 6.8156 | 6.5703e−12 | 0.157961 | 0.098979 | 204 | 232 | 172 | 26.197 |
| EAxxR | HHhhH | 158.7 | 99.5 | 1610.8 | 6.130762 | 6.0465e−10 | 0.098522 | 0.061753 | 167 | 191 | 161 | 19.566 |
| KxxxxE | HhhccC | 156.1 | 97.9 | 1140.5 | 6.155009 | 5.2325e−10 | 0.13687 | 0.08582 | 191 | 208 | 161 | 16.66 |
| SxxN | HhhH | 444.5 | 278.8 | 2709 | 10.47981 | 7.4674e−26 | 0.164083 | 0.102906 | 464 | 532 | 373 | 113.319 |
| NxxA | HhhH | 615.2 | 385.8 | 4642 | 12.19475 | 2.2966e−34 | 0.132529 | 0.083118 | 635 | 762 | 475 | 113.773 |
| RxL | EeC | 168.4 | 105.6 | 952.5 | 6.475264 | 6.6512e−11 | 0.176798 | 0.110913 | 191 | 218 | 147 | 40.276 |
| NxG | HcC | 306.9 | 192.6 | 1423.3 | 8.859907 | 5.6640e−19 | 0.215626 | 0.135299 | 345 | 401 | 287 | 66.643 |
| DxA | EcC | 185.1 | 116.1 | 1247 | 6.718472 | 1.2812e−11 | 0.148436 | 0.093142 | 190 | 220 | 143 | 27.415 |
| GF | CE | 273.1 | 171.4 | 2043.3 | 8.118336 | 3.2802e−16 | 0.133656 | 0.083872 | 291 | 321 | 212 | 77.768 |
| LxxxL | HhhhH | 997.1 | 625.8 | 27017.2 | 15.01725 | 3.8391e−51 | 0.036906 | 0.023163 | 982 | 1113 | 809 | 274.286 |
| ExxxQ | HhhcC | 146.5 | 92 | 726.3 | 6.086124 | 8.1812e−10 | 0.201707 | 0.12661 | 180 | 200 | 153 | 18.605 |
| FG | EC | 205.6 | 129.1 | 2232.1 | 6.938062 | 2.7367e−12 | 0.092101 | 0.057832 | 230 | 269 | 170 | 66.387 |
| TxA | EcC | 184.9 | 116.2 | 1173.5 | 6.718406 | 1.2831e−11 | 0.157563 | 0.098991 | 207 | 238 | 151 | 28.363 |
| SxxP | HhcC | 304.6 | 191.7 | 1389.7 | 8.784923 | 1.1050e−18 | 0.219184 | 0.137925 | 344 | 403 | 238 | 54.435 |
| YxE | EeE | 316.8 | 199.4 | 2122.7 | 8.730258 | 1.7640e−18 | 0.149244 | 0.093957 | 332 | 360 | 245 | 78.824 |
| DxT | ChH | 325.9 | 205.3 | 1490.9 | 9.064351 | 8.8406e−20 | 0.218593 | 0.1377 | 337 | 422 | 287 | 58.774 |
| SxG | HhC | 349.5 | 220.3 | 1705.1 | 9.325761 | 7.7389e−21 | 0.204973 | 0.129216 | 423 | 481 | 340 | 54.017 |
| TxL | ChH | 162.1 | 102.2 | 1235.2 | 6.186318 | 4.2666e−10 | 0.131234 | 0.082742 | 169 | 187 | 128 | 40.459 |
| TxxR | HhhH | 765 | 482.3 | 4295 | 13.66071 | 1.2139e−42 | 0.178114 | 0.1123 | 802 | 918 | 592 | 168.53 |
| VxxxK | HhhhH | 731.6 | 461.5 | 5991.9 | 13.08537 | 2.7448e−39 | 0.122098 | 0.077025 | 816 | 955 | 651 | 134.532 |
| SxxxL | HhhhH | 397 | 250.5 | 6529.4 | 9.436829 | 2.6110e−21 | 0.060802 | 0.038369 | 451 | 505 | 397 | 101.928 |
| YxY | CcC | 288.7 | 182.3 | 1760.3 | 8.320026 | 6.1115e−17 | 0.164006 | 0.10358 | 293 | 340 | 185 | 93.01 |
| YxxxA | HhhhH | 236.1 | 149.1 | 3917.6 | 7.260707 | 2.6193e−13 | 0.060266 | 0.038068 | 270 | 300 | 229 | 57.862 |
| QxxL | HhhH | 1100.1 | 695.9 | 9726.7 | 15.90009 | 4.3300e−57 | 0.113101 | 0.071549 | 1109 | 1293 | 900 | 204.094 |
| SxxxxE | ChhhhH | 255.8 | 161.8 | 2369.5 | 7.653127 | 1.3452e−14 | 0.107955 | 0.068296 | 294 | 334 | 245 | 39.409 |
| HxD | ChH | 172.1 | 108.9 | 762.7 | 6.538917 | 4.3732e−11 | 0.225646 | 0.142806 | 177 | 217 | 150 | 51.532 |
| RxxN | HhhC | 163.9 | 103.7 | 766.6 | 6.352558 | 1.4905e−10 | 0.213801 | 0.135319 | 196 | 217 | 168 | 28.434 |
| NxxxK | HhhhH | 677.6 | 429.3 | 3506.7 | 12.79517 | 1.2149e−37 | 0.19323 | 0.122411 | 705 | 832 | 558 | 129.092 |
| AxxxE | HhhhH | 369.9 | 234.4 | 5304.5 | 9.049512 | 9.7444e−20 | 0.069733 | 0.044196 | 418 | 481 | 332 | 62.946 |
| DxxI | HhhH | 616.4 | 390.7 | 5172.8 | 11.87378 | 1.1089e−32 | 0.119162 | 0.075536 | 671 | 756 | 543 | 110.773 |
| NxD | ChH | 495.1 | 313.9 | 2040 | 11.12133 | 6.9636e−29 | 0.242696 | 0.153854 | 510 | 643 | 414 | 84.876 |
| SxD | ChH | 668.8 | 424.4 | 2701 | 12.92494 | 2.2948e−38 | 0.247612 | 0.157111 | 682 | 847 | 535 | 117.318 |
| SxxS | ChhH | 231.8 | 147.1 | 1773.6 | 7.288639 | 2.1527e−13 | 0.130695 | 0.082959 | 256 | 295 | 197 | 65.521 |
| DxxxR | ChhhH | 322.4 | 204.7 | 1923.2 | 8.701026 | 2.2763e−18 | 0.167637 | 0.106447 | 347 | 378 | 250 | 52.532 |
| QxxF | HhhH | 273.6 | 173.9 | 2934.2 | 7.798778 | 4.2571e−15 | 0.093245 | 0.059253 | 289 | 316 | 237 | 60.216 |
| DxxxL | HhhhH | 575.4 | 366.1 | 6298.7 | 11.27182 | 1.2269e−29 | 0.091352 | 0.058122 | 643 | 702 | 516 | 117.811 |
| FxxR | HhhH | 351 | 223.5 | 3213.2 | 8.837814 | 6.6518e−19 | 0.109237 | 0.06957 | 379 | 434 | 315 | 101.994 |
| RxxA | HhhC | 210.3 | 134 | 1114.3 | 7.029478 | 1.4404e−12 | 0.188728 | 0.120238 | 264 | 288 | 217 | 41.829 |
| RxxxK | HhhhH | 1047 | 667.3 | 5094.2 | 15.76929 | 3.5148e−56 | 0.205528 | 0.130986 | 1109 | 1350 | 881 | 229.876 |
| HxxD | HhhH | 233.8 | 149 | 1324.2 | 7.369841 | 1.1824e−13 | 0.176559 | 0.112552 | 244 | 288 | 201 | 45.746 |
| ExxxP | HhhcC | 195.4 | 124.6 | 1156.3 | 6.718992 | 1.2654e−11 | 0.168987 | 0.107727 | 227 | 263 | 200 | 41.813 |
| KxxxE | HhhhH | 2766.8 | 1765.1 | 13152.5 | 25.62491 | 5.5898e−145 | 0.210363 | 0.1342 | 2615 | 3468 | 1999 | 431.109 |
| TxxN | HhhH | 437.5 | 279.1 | 2805.4 | 9.989921 | 1.1590e−23 | 0.155949 | 0.099494 | 452 | 523 | 353 | 80.127 |
| QxG | HhC | 389.7 | 248.6 | 1652.1 | 9.705388 | 2.0025e−22 | 0.235882 | 0.150503 | 468 | 545 | 384 | 68.89 |
| TxD | ChH | 596.6 | 380.9 | 2366.4 | 12.06539 | 1.1295e−33 | 0.252113 | 0.160964 | 614 | 769 | 469 | 103.233 |
| ExxG | EecC | 416.3 | 266 | 2056.9 | 9.876549 | 3.6490e−23 | 0.202392 | 0.129319 | 418 | 505 | 320 | 71.375 |
| FxxxA | HhhhH | 223.3 | 142.7 | 5346.2 | 6.83435 | 5.5321e−12 | 0.041768 | 0.0267 | 248 | 306 | 218 | 78.557 |
| LxxxF | HhhhH | 296.1 | 189.7 | 7589.4 | 7.81986 | 3.5385e−15 | 0.039015 | 0.025001 | 334 | 359 | 275 | 99.347 |
| RxG | HcC | 600.4 | 385.3 | 2430.5 | 11.94617 | 4.7458e−33 | 0.247027 | 0.158526 | 649 | 770 | 565 | 99.981 |
| DxL | ChH | 284.2 | 182.4 | 1624.1 | 8.001921 | 8.4214e−16 | 0.174989 | 0.112298 | 276 | 344 | 233 | 62.639 |
| PGxP | CCcC | 176.6 | 113.4 | 1196.2 | 6.242508 | 2.9487e−10 | 0.147634 | 0.094769 | 184 | 218 | 139 | 29.145 |
| DxG | HcC | 432.5 | 277.7 | 1780.1 | 10.11318 | 3.3685e−24 | 0.242964 | 0.15599 | 473 | 585 | 397 | 65.071 |
| DxG | HhC | 361.9 | 232.4 | 1588.1 | 9.195611 | 2.5922e−20 | 0.227882 | 0.146327 | 420 | 495 | 336 | 60.8 |
| RxxN | HhhH | 493 | 316.8 | 2440.1 | 10.61521 | 1.7471e−26 | 0.202041 | 0.129816 | 501 | 583 | 395 | 101.528 |
| AxxQ | HhhH | 1213 | 780.1 | 7792 | 16.34001 | 3.4909e−60 | 0.155672 | 0.100112 | 1229 | 1452 | 953 | 204.164 |
| ExxN | HhhH | 1108.5 | 713.4 | 5126.3 | 15.94207 | 2.2333e−57 | 0.216238 | 0.13917 | 1069 | 1307 | 840 | 232.803 |
| DxV | ChH | 274.2 | 176.5 | 1472.4 | 7.839595 | 3.1082e−15 | 0.186227 | 0.119867 | 292 | 321 | 232 | 52.187 |
| TxxxG | EcccC | 266.6 | 171.7 | 1990.3 | 7.577823 | 2.3879e−14 | 0.13395 | 0.086262 | 296 | 340 | 245 | 61.191 |
| AxV | CeE | 213.1 | 137.3 | 2617.4 | 6.642462 | 2.0749e−11 | 0.081417 | 0.052467 | 243 | 276 | 193 | 40.286 |
| ExxKR | HhhHH | 190.5 | 122.9 | 1294.5 | 6.413164 | 9.7168e−11 | 0.147161 | 0.094917 | 220 | 245 | 190 | 33.813 |
| SxL | ChH | 229.3 | 147.9 | 1709.6 | 7.001759 | 1.7166e−12 | 0.134125 | 0.086519 | 245 | 278 | 192 | 47.142 |
| DxP | ChH | 163.2 | 105.3 | 784.1 | 6.063957 | 9.1857e−10 | 0.208137 | 0.134247 | 175 | 196 | 132 | 27.338 |
| AxG | HhC | 719.4 | 465.5 | 3596.3 | 12.61434 | 1.2059e−36 | 0.200039 | 0.12943 | 843 | 967 | 694 | 130.922 |
| QxxA | HhhH | 1224.8 | 792.5 | 8547.3 | 16.12184 | 1.2114e−58 | 0.143297 | 0.092719 | 1219 | 1484 | 974 | 208.072 |
| PxxxL | HhhhH | 274.8 | 178.1 | 3402.7 | 7.445908 | 6.4391e−14 | 0.080759 | 0.052333 | 312 | 341 | 258 | 76.433 |
| GAD | CCC | 214.2 | 138.8 | 1524.5 | 6.711627 | 1.3044e−11 | 0.140505 | 0.091053 | 221 | 284 | 180 | 35.942 |
| RxT | EeC | 180.5 | 117.1 | 856 | 6.301282 | 2.0319e−10 | 0.210864 | 0.136844 | 190 | 211 | 127 | 41.096 |

TABLE 36-continued (Table 36, in its entirety, discloses SEQ ID NOS 3,187-5,226, respectively, in order of appearance)

| Sequence | Structure | In Epi-topes | Ex-pected In Epi | In PDB | Z-Score | P-Value Upper | Observed Ratio | Null Prob-ability | Num Crystal Sets | Num Interface Intersets | Num Chain-sets 25 | Non-Water Solvent |
|---|---|---|---|---|---|---|---|---|---|---|---|---|
| IxQ | EeE | 206.3 | 134 | 2177 | 6.450579 | 7.4700e-11 | 0.094763 | 0.061539 | 224 | 231 | 178 | 52.446 |
| PxxxK | HhhhH | 653.9 | 424.7 | 3404.9 | 11.88889 | 9.2174e-33 | 0.192047 | 0.124727 | 683 | 814 | 550 | 106.479 |
| DGR | CCC | 235.9 | 153.2 | 1180.8 | 7.15978 | 5.5359e-13 | 0.19978 | 0.129763 | 266 | 295 | 185 | 31.236 |
| YH | HH | 259.5 | 168.6 | 1432.6 | 7.45738 | 6.0182e-14 | 0.181139 | 0.117657 | 236 | 291 | 175 | 73.31 |
| PxxL | HhhH | 608.9 | 395.6 | 6143.7 | 11.08991 | 9.3855e-29 | 0.09911 | 0.064384 | 643 | 716 | 482 | 107.923 |
| RxxG | HhcC | 659.6 | 428.8 | 2824.2 | 12.10492 | 6.8433e-34 | 0.233553 | 0.151816 | 731 | 878 | 617 | 99.95 |
| ExY | EeE | 264 | 171.7 | 2049.9 | 7.357882 | 1.2583e-13 | 0.128787 | 0.083765 | 278 | 310 | 235 | 72.719 |
| DxxQ | HhhH | 723.6 | 471.1 | 3555.4 | 12.48768 | 5.9445e-36 | 0.203521 | 0.132515 | 770 | 883 | 627 | 128.257 |
| LxxE | HhhH | 1464.3 | 953.5 | 12363.8 | 17.21774 | 1.3074e-66 | 0.118434 | 0.077123 | 1431 | 1679 | 1159 | 242.872 |
| ExxG | HhcC | 744.6 | 484.9 | 3281.4 | 12.77534 | 1.5440e-37 | 0.226915 | 0.147772 | 841 | 980 | 713 | 126.74 |
| ExxxE | HhhhC | 174.4 | 113.6 | 865.2 | 6.122948 | 6.2923e-10 | 0.201572 | 0.131275 | 217 | 256 | 201 | 29.344 |
| VxP | CcH | 241 | 157.2 | 1873.4 | 6.980528 | 1.9763e-12 | 0.128643 | 0.083925 | 283 | 319 | 238 | 39.774 |
| AS | HC | 387 | 252.5 | 1734.5 | 9.157518 | 3.6376e-20 | 0.223145 | 0.145589 | 431 | 493 | 330 | 68.227 |
| TxxD | ChhH | 532.6 | 347.6 | 3154.7 | 10.52015 | 4.7150e-26 | 0.168827 | 0.11018 | 570 | 661 | 449 | 96.783 |
| KxG | HhC | 794.3 | 518.5 | 3293.5 | 13.19624 | 6.3329e-40 | 0.241172 | 0.157426 | 873 | 1027 | 674 | 123.629 |
| TxK | ChH | 363.6 | 237.5 | 1518.2 | 8.90932 | 3.5284e-19 | 0.239494 | 0.156432 | 358 | 438 | 263 | 46.819 |
| YxR | EeE | 222.6 | 145.4 | 1667.1 | 6.697394 | 1.4262e-11 | 0.133525 | 0.087238 | 235 | 256 | 181 | 62.069 |
| ExxxK | HhhhH | 3252.3 | 2124.9 | 15568.8 | 26.31791 | 8.1352e-153 | 0.208899 | 0.136488 | 2973 | 4024 | 2223 | 531.075 |
| LxxxI | HhhhH | 431.1 | 282 | 13352.3 | 8.970538 | 1.9380e-19 | 0.032287 | 0.021123 | 457 | 511 | 375 | 146.35 |
| CxA | CcC | 240 | 157.1 | 1719.3 | 6.936502 | 2.6998e-12 | 0.139592 | 0.091386 | 251 | 295 | 175 | 79.348 |
| QxxV | HhhH | 486.1 | 318.5 | 4621.8 | 9.73421 | 1.4329e-22 | 0.105175 | 0.068907 | 514 | 576 | 420 | 74.196 |
| NxxK | ChhH | 267.5 | 175.3 | 1255.7 | 7.503694 | 4.2292e-14 | 0.213029 | 0.139633 | 301 | 336 | 254 | 43.698 |
| ExxL | HhhC | 231.1 | 151.5 | 1603.1 | 6.7972 | 7.1660e-12 | 0.144158 | 0.094498 | 281 | 317 | 238 | 41.927 |
| PGT | CCC | 187.5 | 122.9 | 1179.6 | 6.152747 | 5.1368e-10 | 0.158952 | 0.104216 | 207 | 228 | 155 | 38.844 |
| SxxxK | HhhhH | 834.5 | 547.3 | 4847.5 | 13.04413 | 4.6206e-39 | 0.172192 | 0.112901 | 874 | 1041 | 709 | 151.146 |
| QxxS | HhhH | 573.5 | 376.2 | 3395 | 10.78583 | 2.7025e-27 | 0.168925 | 0.110817 | 610 | 690 | 489 | 100.464 |
| RxG | HhC | 536.7 | 352.1 | 2365.3 | 10.66383 | 1.0247e-26 | 0.226906 | 0.148858 | 591 | 683 | 523 | 90.687 |
| KH | HC | 254.7 | 167.1 | 760.9 | 7.669848 | 1.2101e-14 | 0.334735 | 0.219625 | 272 | 327 | 207 | 55.477 |
| DxQ | CcE | 200.1 | 131.3 | 843.7 | 6.532723 | 4.4296e-11 | 0.23717 | 0.155639 | 228 | 251 | 167 | 22.113 |
| ExxN | HhhC | 219.4 | 144 | 1018.4 | 6.778934 | 8.2548e-12 | 0.215436 | 0.141417 | 266 | 312 | 235 | 36.571 |
| GP | EE | 210.9 | 138.4 | 1127.3 | 6.574937 | 3.2980e-11 | 0.187084 | 0.12281 | 208 | 255 | 159 | 43.308 |
| ExH | EeE | 193.8 | 127.3 | 1158.7 | 6.249782 | 2.7732e-10 | 0.167256 | 0.109845 | 210 | 230 | 172 | 59.385 |
| IxY | EeE | 243 | 159.7 | 3724.8 | 6.738568 | 1.0556e-11 | 0.065238 | 0.042872 | 281 | 307 | 206 | 68.244 |
| TS | CH | 275.6 | 181.2 | 1047.3 | 7.71034 | 8.6337e-15 | 0.263153 | 0.173029 | 270 | 302 | 172 | 48.603 |
| AA | HC | 564.4 | 371.6 | 2472.5 | 10.85223 | 1.3234e-27 | 0.228271 | 0.150281 | 617 | 755 | 525 | 87.719 |
| HxxxA | HhhhH | 224.3 | 147.7 | 2542.3 | 6.491995 | 5.6070e-11 | 0.088227 | 0.058106 | 255 | 282 | 222 | 55.81 |
| RxS | EeC | 232.5 | 153.2 | 1206.4 | 6.864615 | 4.5085e-12 | 0.192805 | 0.126997 | 243 | 291 | 130 | 99.543 |
| AxP | CcH | 300.6 | 198.2 | 1840.7 | 7.701465 | 9.0209e-15 | 0.163307 | 0.107667 | 349 | 397 | 279 | 55.725 |
| AxxP | HhcC | 384.9 | 253.9 | 1977.2 | 8.806219 | 8.7288e-19 | 0.194669 | 0.128413 | 430 | 503 | 365 | 64.191 |
| AxxG | HhcC | 596.4 | 393.6 | 3729.4 | 10.81149 | 2.0296e-27 | 0.159918 | 0.105527 | 706 | 816 | 603 | 104.595 |
| VxxxS | HhhhH | 240.9 | 159 | 3366.1 | 6.65677 | 1.8435e-11 | 0.071567 | 0.047228 | 286 | 320 | 238 | 57.927 |
| GxF | CcE | 309.7 | 204.4 | 2645.7 | 7.664502 | 1.1912e-14 | 0.117058 | 0.07727 | 359 | 372 | 247 | 73.042 |
| AxN | HcC | 206.2 | 136.2 | 1076.8 | 6.420579 | 9.1640e-11 | 0.191493 | 0.126461 | 233 | 274 | 193 | 36.263 |
| QxxK | HhhH | 1225.8 | 809.9 | 5705.9 | 15.77567 | 3.0884e-56 | 0.21483 | 0.141944 | 1252 | 1543 | 971 | 183.382 |
| SxY | EeE | 224.1 | 148.1 | 2359.2 | 6.447301 | 7.5251e-11 | 0.09499 | 0.06279 | 259 | 270 | 162 | 64.803 |
| DxDG | CcCC | 197.6 | 130.7 | 1653 | 6.102896 | 6.9206e-10 | 0.11954 | 0.079041 | 179 | 191 | 98 | 30.41 |
| AxxxE | CchhH | 196.6 | 130 | 1472.9 | 6.114589 | 6.4488e-10 | 0.133478 | 0.088278 | 231 | 266 | 193 | 34.905 |
| KxxxL | HhhhH | 975 | 645.5 | 8499.3 | 13.48896 | 1.1986e-41 | 0.114715 | 0.075953 | 1031 | 1221 | 860 | 169.471 |
| TxH | EeE | 235.2 | 155.8 | 1626.2 | 6.691361 | 1.4731e-11 | 0.144632 | 0.095796 | 262 | 288 | 193 | 60.839 |
| YxxT | HhhH | 223.7 | 148.3 | 2165.8 | 6.417924 | 9.1255e-11 | 0.103287 | 0.068461 | 239 | 265 | 193 | 48.734 |
| SA | CH | 566.6 | 375.7 | 2576.3 | 10.65475 | 1.1178e-26 | 0.219928 | 0.145839 | 552 | 686 | 411 | 118.754 |
| DxxN | HhhH | 709.7 | 470.7 | 3574.6 | 11.82169 | 2.0234e-32 | 0.19854 | 0.13168 | 758 | 884 | 582 | 111.272 |
| RxG | EeC | 261.5 | 173.5 | 1393.1 | 7.141804 | 6.1825e-13 | 0.187711 | 0.124531 | 263 | 313 | 216 | 70.077 |
| ExxL | HhhH | 2067.7 | 1372.8 | 16331.3 | 19.59683 | 1.0853e-85 | 0.12661 | 0.084059 | 2024 | 2416 | 1566 | 366.474 |
| DxT | EcC | 210.2 | 139.6 | 1345.2 | 6.313609 | 1.8180e-10 | 0.156259 | 0.103764 | 231 | 261 | 175 | 42.758 |
| GVP | CCC | 226.5 | 150.5 | 1776.5 | 6.477441 | 6.1803e-11 | 0.127498 | 0.084706 | 271 | 290 | 172 | 35.726 |
| NxxE | HhhH | 551.2 | 366.4 | 2767 | 10.36368 | 2.4310e-25 | 0.199205 | 0.132425 | 569 | 681 | 482 | 93.396 |
| QxxP | HhcC | 214.3 | 142.7 | 978 | 6.490339 | 5.7784e-11 | 0.219121 | 0.145866 | 252 | 286 | 217 | 34.293 |

SEQUENCE LISTING (5231 sequences)

SEQ ID NO: 1 - protein, 164 aa, Artificial Sequence
  Description of Artificial Sequence: Synthetic polypeptide
MIIREATVQDYEEVARLHTQVHEAHVKERGDIFRSNEPTLNPSFFQAAVQGEKSTVLVFVDEREKIGAYSVIHLVQTPLLPTMQQRKTVYISDLCVDETRRGGGIGRLIFEAIISYGKAHQVDAIELDVYDFNDRAKAFYHSLGMRCQKQTMELPLLEHHHHHH

SEQ ID NO: 2 - protein, 271 aa, Artificial Sequence
  Description of Artificial Sequence: Synthetic polypeptide
NDDVEFRYADFLFKNNNYAEAIEVFNKLEAKKYNSPYIYNRRAVCYYELAKYDLAQKDIETYFSKVNATKAKSADFEYYGKILMKKGQDSLAIQQYQAAVDRDTTRLDMYGQIGSYFYNKGNFPLAIQYMSKQIRPTTTDPKVFYELGQAYYYNKEYVKADSSFVKVLELKPNIYIGYLWRARANAAQDPDTKQGLAKPYYEKLIEVCAPGGAKYKDELIEANEYIAYYYTINRDKVKADAAWKNILALDPTNKKAIDGLKMKLEHHHHHH

SEQ ID NO: 3 - protein, 160 aa, Artificial Sequence
  Description of Artificial Sequence: Synthetic polypeptide
MKKVYIKTFGCQMNEYDSDKMADVLGSAEGMVKTDNPEEADVILFNTCSVREKAQEKVFSDLGRIRPLKEANPDLIIGVGGCVASQEGDAIVKRAPFVDVVFGPQTLHRLPDLIESRKQSGRSQVDISFPEIEKFDHIPPAKVDGGAAFVSILEHHHHHH

SEQ ID NO: 4 - protein, 396 aa, Artificial Sequence
  Description of Artificial Sequence: Synthetic polypeptide
MGKTLSEIAQQLSTPQKVKKTVHKEVEATRAVPKVQLIYAFNGTGKTRLSRDFKQLLESKVHDGEGEDEAEQSALSRKKILYYNAFTEDLFYWDNDLQEDAEPKLKVQPNSYTNWLLTLLKDLGQDSNIVRYFQRYANDKLTPHFNPDFTEITFSMERGNDERSAHIKLSKGEESNFIWSVFYTLLDQVVTILNVADPDARETHAFDQLKYVFIDDPVSSLDDNHLIELAVNLAGLIKSSESDLKFIITTHSPIFYNVLFNELNGKVCYMLESFEDGTFALTEKYGDSNKSFSYHLHLKQTIEQAIADNNVERYHFTLLRNLYEKTASFLGYPKWSELLPDDKQLYLSRIINFTSASTLSNEAVAEPTPAEKATVKLLLDHLKNNCGFWQQEQKNG

SEQ ID NO: 5 - protein, 113 aa, Artificial Sequence
  Description of Artificial Sequence: Synthetic polypeptide
MNETAVYGSDENIIFMRYVEKLHLDKYSVKNTVKTETMAIQLAEIYVRYRYGERIAEEEKPYLITELPDSWVVEGAKLPYEVAGGVFIIEINKKNGCVLNFLHSKLEHHHHHH

SEQ ID NO: 6 - protein, 300 aa, Artificial Sequence
  Description of Artificial Sequence: Synthetic polypeptide
MSDDNSHSSDTISNKKGFFSLLLSQLFHGEPKNRDELLALIRDSGQNDLIDEDTRDMLEGVMDIADQRVRDIMIPRSQMITLKRNQTLDECLDVIIESAHSRFPVISEDKDHIEGILMAKDLLPFMRSDAEAFSMDKVLRQAVVVPESKRVDRMLKEFRSQRYHMAIVIDEFGGVSGLVTIEDILELIVGEIEDEYDEEDDIDFRQLSRHTWTVRALASIEDFNEAFGTHFSDEEVDTIGGLVMQAFGHLPARGETIDIDGYQFKVAMADSRRIIQVHVKIPDDSPQPKLDELEHHHHHH

SEQ ID NO: 7 - protein, 411 aa, Artificial Sequence
  Description of Artificial Sequence: Synthetic polypeptide
MQSFDVVIAGGGMVGLALACGLQGSGLRIAVLEKQAAEPQTLGKGHALRVSAINAASECLLRHIGVWENLVAQRVSPYNDMQVWDKDSFGKISFSGEEFGFSHLGHIIENPVIQQVLWQRASQLSDITLLSPTSLKQVAWGENEAFITLQDDSMLTARLVVGADGAHSWLRQHADIPLTFWDYGHHALVANIRTEHPHQSVARQAFHGDGILAFLPLDDPHLCSIVWSLSPEQALVMQSLPVEEFNRQVAMAFDMRLGLCELESERQTFPLMGRYARSFAAHRLVLVGDAAHTIHPLAGQGVNLGFMDVAELIAELKRLQTQGKDIGQHLYLRRYERRRKHSAAVMLASMQGFRELFDGDNPAKKLLRDVGLVLADKLPGIKPTLVRQAMGLHDLPDWLSAGKLEHHHHHH

SEQ ID NO: 8 - protein, 469 aa, Artificial Sequence
  Description of Artificial Sequence: Synthetic polypeptide
MGHHHHHHSHMNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 9 - protein, 116 aa, Artificial Sequence
  Description of Artificial Sequence: Synthetic polypeptide
IDNPTPKSSMTFKELYDEWLLVYEKEVQNSTYYKTTRAFEKHVLPVIGSTKLSDFTPMELQNFRNDLSEKLKFARKLFGMVRKVFNHAALLSYIQANPALPVTSQGIKLEHHHHHH

SEQ ID NO: 10 - protein, 260 aa, Artificial Sequence
  Description of Artificial Sequence: Synthetic polypeptide
MPESYWEKVSGKNIPSSLDLYPIIHNYLQEDDEILDIGCGSGKISLELASLGYSVTGIDINSEAIRLAETAARSPGLNQKTGGKAEFKVENASSLSFHDSSFDFAVMQAFLTSVPDPKERSRIIKEVFRVLKPGAYLYLVEFGQNWHLKLYRKRYLHDFPITKEEGSFLARDPETGETEFIAHHFTEKELVFLLTDCRFEIDYFRVKELETRTGNKILGFVIIAQKLLEHHHHHHIMRFYGADDAIQSGEYQMPEIKVVK

SEQ ID NO: 11 - protein, 250 aa, Artificial Sequence
  Description of Artificial Sequence: Synthetic polypeptide
MARAIWKGAISFGLVHIPVSLSAATSSQGIDFDWLDQRSMEPVGYKRVNKVTGKEIERENIVKGVEYEKGRYVVLSEEEIRAAHPKSTQTIEIFAFVDSQEIPLQHFDTPYYLVPDRRGGKVYALLRETLERTGKVALANVVLHTRQHLALLRPLQDALVLITLRWPSQVRSLDGLELDESVTEAKLDKRELEMAKRLVEDMASHWEPDEYKDSFSDKIMKLVEEKAAKGQLHAVEEEEEVAGKGADIID

SEQ ID NO: 12 - protein, 2 aa, Artificial Sequence
  Description of Artificial Sequence: Synthetic peptide
HH

SEQ ID NO: 13 - protein, 2 aa, Artificial Sequence
  Description of Artificial Sequence: Synthetic peptide
WC

SEQ ID NO: 14 - protein, 2 aa, Artificial Sequence
  Description of Artificial Sequence: Synthetic peptide
CH

SEQ ID NO: 15 - protein, 2 aa, Artificial Sequence
  Description of Artificial Sequence: Synthetic peptide
HM

SEQ ID NO: 16 - protein, 2 aa, Artificial Sequence
  Description of Artificial Sequence: Synthetic peptide
CS

SEQ ID NO: 17 - protein, 3 aa, Artificial Sequence
  Description of Artificial Sequence: Synthetic peptide
SCW

SEQ ID NO: 18 - protein, 3 aa, Artificial Sequence
  Description of Artificial Sequence: Synthetic peptide
HHH

SEQ ID NO: 19 - protein, 3 aa, Artificial Sequence
  Description of Artificial Sequence: Synthetic peptide
WCG

SEQ ID NO: 20 - protein, 3 aa, Artificial Sequence
  Description of Artificial Sequence: Synthetic peptide
SHM

SEQ ID NO: 21 - protein, 3 aa, Artificial Sequence
  Description of Artificial Sequence: Synthetic peptide
VAC

SEQ ID NO: 22 - protein, 4 aa, Artificial Sequence
  Description of Artificial Sequence: Synthetic peptide
CSAG

SEQ ID NO: 23 - protein, 4 aa, Artificial Sequence
  Description of Artificial Sequence: Synthetic peptide
TQWC

SEQ ID NO: 24 - protein, 4 aa, Artificial Sequence
  Description of Artificial Sequence: Synthetic peptide
HCGV

SEQ ID NO: 25 - protein, 4 aa, Artificial Sequence
  Description of Artificial Sequence: Synthetic peptide
ACNG

SEQ ID NO: 26 - protein, 4 aa, Artificial Sequence
  Description of Artificial Sequence: Synthetic peptide
DACQ

SEQ ID NO: 27 - protein, 2 aa, Artificial Sequence
  Description of Artificial Sequence: Synthetic peptide
CW

SEQ ID NO: 28 - protein, 2 aa, Artificial Sequence
  Description of Artificial Sequence: Synthetic peptide
HH

SEQ ID NO: 29 - protein, 2 aa, Artificial Sequence
  Description of Artificial Sequence: Synthetic peptide
WC

SEQ ID NO: 30 - protein, 2 aa, Artificial Sequence
  Description of Artificial Sequence: Synthetic peptide
HM

SEQ ID NO: 31 - protein, 2 aa, Artificial Sequence
  Description of Artificial Sequence: Synthetic peptide
GK

SEQ ID NO: 32 - protein, 3 aa, Artificial Sequence
  Description of Artificial Sequence: Synthetic peptide
PTW

SEQ ID NO: 33 - protein, 3 aa, Artificial Sequence
  Description of Artificial Sequence: Synthetic peptide
CAT

SEQ ID NO: 34 - protein, 3 aa, Artificial Sequence
  Description of Artificial Sequence: Synthetic peptide
VAC

SEQ ID NO: 35 - protein, 3 aa, Artificial Sequence
  Description of Artificial Sequence: Synthetic peptide
GSC

SEQ ID NO: 36 - protein, 3 aa, Artificial Sequence
  Description of Artificial Sequence: Synthetic peptide
VGK

SEQ ID NO: 37 - protein, 4 aa, Artificial Sequence
  Description of Artificial Sequence: Synthetic peptide
AGKT

SEQ ID NO: 38 - protein, 4 aa, Artificial Sequence
  Description of Artificial Sequence: Synthetic peptide
VGKS

SEQ ID NO: 39 - protein, 4 aa, Artificial Sequence
  Description of Artificial Sequence: Synthetic peptide
GNLA

SEQ ID NO: 40 - protein, 4 aa, Artificial Sequence
  Description of Artificial Sequence: Synthetic peptide
QGLG

SEQ ID NO: 41 - protein, 4 aa, Artificial Sequence
  Description of Artificial Sequence: Synthetic peptide
AAGK

SEQ ID NO: 42 - protein, 2 aa, Artificial Sequence
  Description of Artificial Sequence: Synthetic peptide
LP

SEQ ID NO: 43 - protein, 2 aa, Artificial Sequence
  Description of Artificial Sequence: Synthetic peptide
GY

SEQ ID NO: 44 - protein, 2 aa, Artificial Sequence
  Description of Artificial Sequence: Synthetic peptide
PN

SEQ ID NO: 45 - protein, 2 aa, Artificial Sequence
  Description of Artificial Sequence: Synthetic peptide
GK

SEQ ID NO: 46 - protein, 2 aa, Artificial Sequence
  Description of Artificial Sequence: Synthetic peptide
DG

SEQ ID NO: 47 - protein, 2 aa, Artificial Sequence
  Description of Artificial Sequence: Synthetic peptide
PG

SEQ ID NO: 48 - protein, 2 aa, Artificial Sequence
  Description of Artificial Sequence: Synthetic peptide
GF

SEQ ID NO: 49 - protein, 2 aa, Artificial Sequence
  Description of Artificial Sequence: Synthetic peptide
NG

SEQ ID NO: 50 - protein, 5 aa, Artificial Sequence
  Description of Artificial Sequence: Synthetic peptide
  MOD_RES (2)..(4): Any amino acid
EXXXR

SEQ ID NO: 51 - protein, 5 aa, Artificial Sequence
  Description of Artificial Sequence: Synthetic peptide
  MOD_RES (2)..(4): Any amino acid
RXXXE

SEQ ID NO: 52 - protein, 5 aa, Artificial Sequence
  Description of Artificial Sequence: Synthetic peptide
  MOD_RES (2)..(4): Any amino acid
QXXXD

SEQ ID NO: 53 - protein, 5 aa, Artificial Sequence
  Description of Artificial Sequence: Synthetic peptide
  MOD_RES (2)..(4): Any amino acid
RXXXR

SEQ ID NO: 54 - protein, 5 aa, Artificial Sequence
  Description of Artificial Sequence: Synthetic peptide
  MOD_RES (2)..(4): Any amino acid
EXXXE

SEQ ID NO: 55 - protein, 5 aa, Artificial Sequence
  Description of Artificial Sequence: Synthetic peptide
  MOD_RES (2)..(4): Any amino acid
DXXXR

SEQ ID NO: 56 - protein, 5 aa, Artificial Sequence
  Description of Artificial Sequence: Synthetic peptide
  MOD_RES (2)..(4): Any amino acid
EXXXQ

SEQ ID NO: 57 - protein, 5 aa, Artificial Sequence
  Description of Artificial Sequence: Synthetic peptide
  MOD_RES (2)..(4): Any amino acid
AXXXR

SEQ ID NO: 58 - protein, 5 aa, Artificial Sequence
  Description of Artificial Sequence: Synthetic peptide
YEEVA

SEQ ID NO: 59 - protein, 5 aa, Artificial Sequence
  Description of Artificial Sequence: Synthetic peptide
DRAKA

SEQ ID NO: 60 - protein, 6 aa, Artificial Sequence
  Description of Artificial Sequence: Synthetic peptide
TLNPSF

SEQ ID NO: 61 - protein, 5 aa, Artificial Sequence
  Description of Artificial Sequence: Synthetic peptide
EEVAR

SEQ ID NO: 62 - protein, 6 aa, Artificial Sequence
  Description of Artificial Sequence: Synthetic peptide
DETRRG

SEQ ID NO: 63 - protein, 5 aa, Artificial Sequence
  Description of Artificial Sequence: Synthetic peptide
AIVKR

SEQ ID NO: 64 - protein, 5 aa, Artificial Sequence
  Description of Artificial Sequence: Synthetic peptide
DKMAD

SEQ ID NO: 65 - protein, 5 aa, Artificial Sequence
  Description of Artificial Sequence: Synthetic peptide
IRPLK

SEQ ID NO: 66 - protein, 4 aa, Artificial Sequence
  Description of Artificial Sequence: Synthetic peptide
RIRP

SEQ ID NO: 67 - protein, 5 aa, Artificial Sequence
  Description of Artificial Sequence: Synthetic peptide
FSLLL

SEQ ID NO: 68 - protein, 5 aa, Artificial Sequence
  Description of Artificial Sequence: Synthetic peptide
LALIR

SEQ ID NO: 69 - protein, 4 aa, Artificial Sequence
  Description of Artificial Sequence: Synthetic peptide
QAFG

SEQ ID NO: 70 - protein, 5 aa, Artificial Sequence
  Description of Artificial Sequence: Synthetic peptide
IKGYT

SEQ ID NO: 71 - protein, 5 aa, Artificial Sequence
  Description of Artificial Sequence: Synthetic peptide
KLFGM

SEQ ID NO: 72 - protein, 5 aa, Artificial Sequence
  Description of Artificial Sequence: Synthetic peptide
FTPME

SEQ ID NO: 73 - protein, 6 aa, Artificial Sequence
  Description of Artificial Sequence: Synthetic peptide
PVTSQG

SEQ ID NO: 74 - protein, 5 aa, Artificial Sequence
  Description of Artificial Sequence: Synthetic peptide
GCGSG

SEQ ID NO: 75 - protein, 6 aa, Artificial Sequence
  Description of Artificial Sequence: Synthetic peptide
RVLKPG

SEQ ID NO: 76 - protein, 6 aa, Artificial Sequence
  Description of Artificial Sequence: Synthetic peptide
LASLGY

SEQ ID NO: 77 - protein, 5 aa, Artificial Sequence
  Description of Artificial Sequence: Synthetic peptide
KELVF

SEQ ID NO: 78 - protein, 5 aa, Artificial Sequence
  Description of Artificial Sequence: Synthetic peptide
RMRAR

SEQ ID NO: 79 - protein, 4 aa, Artificial Sequence
  Description of Artificial Sequence: Synthetic peptide
KSLG

SEQ ID NO: 80 - protein, 4 aa, Artificial Sequence
  Description of Artificial Sequence: Synthetic peptide
ARCG

SEQ ID NO: 81 - protein, 5 aa, Artificial Sequence
  Description of Artificial Sequence: Synthetic peptide
SQDAG

SEQ ID NO: 82 - protein, 6 aa, Artificial Sequence
  Description of Artificial Sequence: Synthetic peptide
ADAPVQ

SEQ ID NO: 83 - protein, 5 aa, Artificial Sequence
  Description of Artificial Sequence: Synthetic peptide
KQWLD

SEQ ID NO: 84 - protein, 6 aa, Artificial Sequence
  Description of Artificial Sequence: Synthetic peptide
PLNRFQ

SEQ ID NO: 85 - protein, 5 aa, Artificial Sequence
  Description of Artificial Sequence: Synthetic peptide
RFQNI

SEQ ID NO: 86 - protein, 5 aa, Artificial Sequence
  Description of Artificial Sequence: Synthetic peptide
EAYKF

SEQ ID NO: 87 - protein, 5 aa, Artificial Sequence
  Description of Artificial Sequence: Synthetic peptide
  MOD_RES (2)..(4): Any amino acid
YXXXN

SEQ ID NO: 88 - protein, 5 aa, Artificial Sequence
  Description of Artificial Sequence: Synthetic peptide
  MOD_RES (2)..(4): Any amino acid
EXXXR

SEQ ID NO: 89 - protein, 6 aa, Artificial Sequence
  Description of Artificial Sequence: Synthetic peptide
  MOD_RES (2)..(5): Any amino acid
TXXXXR

SEQ ID NO: 90 - protein, 5 aa, Artificial Sequence
  Description of Artificial Sequence: Synthetic peptide
  MOD_RES (2)..(4): Any amino acid
YXXXR

SEQ ID NO: 91 - protein, 6 aa, Artificial Sequence
  Description of Artificial Sequence: Synthetic peptide
  MOD_RES (2)..(3): Any amino acid
  MOD_RES (5)..(5): Any amino acid
DXXGXG

SEQ ID NO: 92 - protein, 5 aa, Artificial Sequence
  Description of Artificial Sequence: Synthetic peptide
  MOD_RES (2)..(4): Any amino acid
EXXXR

SEQ ID NO: 93 - protein, 5 aa, Artificial Sequence
  Description of Artificial Sequence: Synthetic peptide
  MOD_RES (2)..(4): Any amino acid
EXXXR

SEQ ID NO: 94 - protein, 5 aa, Artificial Sequence
  Description of Artificial Sequence: Synthetic peptide
  MOD_RES (2)..(4): Any amino acid
YXXXQ

SEQ ID NO: 95 - protein, 4 aa, Artificial Sequence
  Description of Artificial Sequence: Synthetic peptide
  MOD_RES (2)..(3): Any amino acid
RXXE

SEQ ID NO: 96 - protein, 5 aa, Artificial Sequence
  Description of Artificial Sequence: Synthetic peptide
  MOD_RES (2)..(4): Any amino acid
KXXXE

SEQ ID NO: 97 - protein, 5 aa, Artificial Sequence
  Description of Artificial Sequence: Synthetic peptide
  MOD_RES (2)..(4): Any amino acid
FXXXQ

SEQ ID NO: 98 - protein, 5 aa, Artificial Sequence
  Description of Artificial Sequence: Synthetic peptide
  MOD_RES (2)..(4): Any amino acid
EXXXR

SEQ ID NO: 99 - protein, 4 aa, Artificial Sequence
  Description of Artificial Sequence: Synthetic peptide
  MOD_RES (3)..(3): Any amino acid
SAXG

SEQ ID NO: 100 - protein, 5 aa, Artificial Sequence
  Description of Artificial Sequence: Synthetic peptide
  MOD_RES (3)..(4): Any amino acid
ISXXT

SEQ ID NO: 101 - protein, 5 aa, Artificial Sequence
  Description of Artificial Sequence: Synthetic peptide
YKTEN

SEQ ID NO: 102 - protein, 5 aa, Artificial Sequence
  Description of Artificial Sequence: Synthetic peptide
  MOD_RES (2)..(4): Any amino acid
YXXXM

SEQ ID NO: 103 - protein, 5 aa, Artificial Sequence
  Description of Artificial Sequence: Synthetic peptide
  MOD_RES (3)..(4): Any amino acid
LTXXE

SEQ ID NO: 104 - protein, 6 aa, Artificial Sequence
  Description of Artificial Sequence: Synthetic peptide
  MOD_RES (2)..(3): Any amino acid
  MOD_RES (5)..(5): Any amino acid
DXXGXG

SEQ ID NO: 105 - protein, 5 aa, Artificial Sequence
  Description of Artificial Sequence: Synthetic peptide
  MOD_RES (3)..(4): Any amino acid
ACXXG

SEQ ID NO: 106 - protein, 6 aa, Artificial Sequence
  Description of Artificial Sequence: Synthetic peptide
  MOD_RES (2)..(4): Any amino acid
RXXXPE

SEQ ID NO: 107 - protein, 6 aa, Artificial Sequence
  Description of Artificial Sequence: Synthetic peptide
  MOD_RES (2)..(3): Any amino acid
  MOD_RES (5)..(5): Any amino acid
LXXKXY

SEQ ID NO: 108 - protein, 5 aa, Artificial Sequence
  Description of Artificial Sequence: Synthetic peptide
  MOD_RES (2)..(4): Any amino acid
KXXXE

SEQ ID NO: 109 - protein, 5 aa, Artificial Sequence
  Description of Artificial Sequence: Synthetic peptide
  MOD_RES (2)..(4): Any amino acid
RXXXH

SEQ ID NO: 110 - protein, 4 aa, Artificial Sequence
  Description of Artificial Sequence: Synthetic peptide
  MOD_RES (2)..(3): Any amino acid
SXXG

SEQ ID NO: 111 - protein, 4 aa, Artificial Sequence
  Description of Artificial Sequence: Synthetic peptide
  MOD_RES (2)..(3): Any amino acid
RXXG

SEQ ID NO: 112 - protein, 5 aa, Artificial Sequence
  Description of Artificial Sequence: Synthetic peptide
  MOD_RES (2)..(4): Any amino acid
SXXXH

SEQ ID NO: 113 - protein, 6 aa, Artificial Sequence
  Description of Artificial Sequence: Synthetic peptide
  MOD_RES (2)..(5): Any amino acid
LXXXXQ

SEQ ID NO: 114 - protein, 5 aa, Artificial Sequence
  Description of Artificial Sequence: Synthetic peptide
  MOD_RES (2)..(4): Any amino acid
QXXXD

SEQ ID NO: 115 - protein, 6 aa, Artificial Sequence
  Description of Artificial Sequence: Synthetic peptide
  MOD_RES (2)..(5): Any amino acid
LXXXXQ

SEQ ID NO: 116 - protein, 5 aa, Artificial Sequence
  Description of Artificial Sequence: Synthetic peptide
  MOD_RES (2)..(4): Any amino acid
EXXXR

SEQ ID NO: 117 - protein, 5 aa, Artificial Sequence
  Description of Artificial Sequence: Synthetic peptide
  MOD_RES (2)..(4): Any amino acid
EXXXR

SEQ ID NO: 118 - protein, 2 aa, Artificial Sequence
  Description of Artificial Sequence: Synthetic peptide
LP

SEQ ID NO: 119 - protein, 2 aa, Artificial Sequence
  Description of Artificial Sequence: Synthetic peptide
GY

SEQ ID NO: 120 - protein, 2 aa, Artificial Sequence
  Description of Artificial Sequence: Synthetic peptide
PN

SEQ ID NO: 121 - protein, 2 aa, Artificial Sequence
  Description of Artificial Sequence: Synthetic peptide
GK

SEQ ID NO: 122 - protein, 2 aa, Artificial Sequence
  Description of Artificial Sequence: Synthetic peptide
DG

SEQ ID NO: 123 - protein, 2 aa, Artificial Sequence
  Description of Artificial Sequence: Synthetic peptide
PG

SEQ ID NO: 124 - protein, 2 aa, Artificial Sequence
  Description of Artificial Sequence: Synthetic peptide
GF

SEQ ID NO: 125 - protein, 2 aa, Artificial Sequence
  Description of Artificial Sequence: Synthetic peptide
NG

SEQ ID NO: 126 - protein, 2 aa, Artificial Sequence
  Description of Artificial Sequence: Synthetic peptide
YP

SEQ ID NO: 127 - protein, 2 aa, Artificial Sequence
  Description of Artificial Sequence: Synthetic peptide
FP

SEQ ID NO: 128 - protein, 2 aa, Artificial Sequence
  Description of Artificial Sequence: Synthetic peptide
FG

SEQ ID NO: 129 - protein, 2 aa, Artificial Sequence
  Description of Artificial Sequence: Synthetic peptide
PF

SEQ ID NO: 130 - protein, 2 aa, Artificial Sequence
  Description of Artificial Sequence: Synthetic peptide
PE

SEQ ID NO: 131 - protein, 2 aa, Artificial Sequence
  Description of Artificial Sequence: Synthetic peptide
TE

SEQ ID NO: 132 - protein, 2 aa, Artificial Sequence
  Description of Artificial Sequence: Synthetic peptide
CW

SEQ ID NO: 133 - protein, 2 aa, Artificial Sequence
  Description of Artificial Sequence: Synthetic peptide
AA

SEQ ID NO: 134 - protein, 2 aa, Artificial Sequence
  Description of Artificial Sequence: Synthetic peptide
GI

SEQ ID NO: 135 - protein, 2 aa, Artificial Sequence
  Description of Artificial Sequence: Synthetic peptide
SA

SEQ ID NO: 136 - protein, 2 aa, Artificial Sequence
  Description of Artificial Sequence: Synthetic peptide
SP

SEQ ID NO: 137 - protein, 2 aa, Artificial Sequence
  Description of Artificial Sequence: Synthetic peptide
AG

SEQ ID NO: 138 - protein, 2 aa, Artificial Sequence
  Description of Artificial Sequence: Synthetic peptide
PD

SEQ ID NO: 139 - protein, 2 aa, Artificial Sequence
  Description of Artificial Sequence: Synthetic peptide
TG

SEQ ID NO: 140 - protein, 2 aa, Artificial Sequence
  Description of Artificial Sequence: Synthetic peptide
EG

SEQ ID NO: 141 - protein, 2 aa, Artificial Sequence
  Description of Artificial Sequence: Synthetic peptide
GL

SEQ ID NO: 142 - protein, 2 aa, Artificial Sequence
  Description of Artificial Sequence: Synthetic peptide
KY

SEQ ID NO: 143 - protein, 2 aa, Artificial Sequence
  Description of Artificial Sequence: Synthetic peptide
SG

SEQ ID NO: 144 - protein, 2 aa, Artificial Sequence
  Description of Artificial Sequence: Synthetic peptide
GW

SEQ ID NO: 145 - protein, 2 aa, Artificial Sequence
  Description of Artificial Sequence: Synthetic peptide
WG

SEQ ID NO: 146 - protein, 2 aa, Artificial Sequence
  Description of Artificial Sequence: Synthetic peptide
PD

SEQ ID NO: 147 - protein, 2 aa, Artificial Sequence
  Description of Artificial Sequence: Synthetic peptide
AS

SEQ ID NO: 148 - protein, 2 aa, Artificial Sequence
  Description of Artificial Sequence: Synthetic peptide
SL

SEQ ID NO: 149 - protein, 2 aa, Artificial Sequence
  Description of Artificial Sequence: Synthetic peptide
SF

SEQ ID NO: 150 - protein, 2 aa, Artificial Sequence
  Description of Artificial Sequence: Synthetic peptide
RG

SEQ ID NO: 151 - protein, 2 aa, Artificial Sequence
  Description of Artificial Sequence: Synthetic peptide
DH

SEQ ID NO: 152 - protein, 2 aa, Artificial Sequence
  Description of Artificial Sequence: Synthetic peptide
GN

SEQ ID NO: 153 - protein, 2 aa, Artificial Sequence
  Description of Artificial Sequence: Synthetic peptide
IP

SEQ ID NO: 154 - protein, 2 aa, Artificial Sequence
  Description of Artificial Sequence: Synthetic peptide
PQ

SEQ ID NO: 155 - protein, 2 aa, Artificial Sequence
  Description of Artificial Sequence: Synthetic peptide
WC

SEQ ID NO: 156 - protein, 2 aa, Artificial Sequence
  Description of Artificial Sequence: Synthetic peptide
RH

SEQ ID NO: 157 - protein, 2 aa, Artificial Sequence
  Description of Artificial Sequence: Synthetic peptide
FS

SEQ ID NO: 158 - protein, 2 aa, Artificial Sequence
  Description of Artificial Sequence: Synthetic peptide
GP

SEQ ID NO: 159 - protein, 2 aa, Artificial Sequence
  Description of Artificial Sequence: Synthetic peptide
HP

SEQ ID NO: 160 - protein, 2 aa, Artificial Sequence
  Description of Artificial Sequence: Synthetic peptide
PY

SEQ ID NO: 161 - protein, 2 aa, Artificial Sequence
  Description of Artificial Sequence: Synthetic peptide
ER

SEQ ID NO: 162 - protein, 2 aa, Artificial Sequence
  Description of Artificial Sequence: Synthetic peptide
TN

SEQ ID NO: 163 - protein, 2 aa, Artificial Sequence
  Description of Artificial Sequence: Synthetic peptide
HP

SEQ ID NO: 164 - protein, 2 aa, Artificial Sequence
  Description of Artificial Sequence: Synthetic peptide
YS

SEQ ID NO: 165 - protein, 2 aa, Artificial Sequence
  Description of Artificial Sequence: Synthetic peptide
VG

SEQ ID NO: 166 - protein, 2 aa, Artificial Sequence
  Description of Artificial Sequence: Synthetic peptide
CH

SEQ ID NO: 167 - protein, 2 aa, Artificial Sequence
  Description of Artificial Sequence: Synthetic peptide
GS

SEQ ID NO: 168 - protein, 2 aa, Artificial Sequence
  Description of Artificial Sequence: Synthetic peptide
EH

SEQ ID NO: 169 - protein, 2 aa, Artificial Sequence
  Description of Artificial Sequence: Synthetic peptide
PH

SEQ ID NO: 170 - protein, 2 aa, Artificial Sequence
  Description of Artificial Sequence: Synthetic peptide
GF

SEQ ID NO: 171 - protein, 2 aa, Artificial Sequence
  Description of Artificial Sequence: Synthetic peptide
EN

SEQ ID NO: 172 - protein, 2 aa, Artificial Sequence
  Description of Artificial Sequence: Synthetic peptide
GQ

SEQ ID NO: 173 - protein, 2 aa, Artificial Sequence
  Description of Artificial Sequence: Synthetic peptide
CG

SEQ ID NO: 174 - protein, 2 aa, Artificial Sequence
  Description of Artificial Sequence: Synthetic peptide
QY

SEQ ID NO: 175 - protein, 2 aa, Artificial Sequence
  Description of Artificial Sequence: Synthetic peptide
GT

SEQ ID NO: 176 - protein, 2 aa, Artificial Sequence
  Description of Artificial Sequence: Synthetic peptide
LG

SEQ ID NO: 177 - protein, 2 aa, Artificial Sequence
  Description of Artificial Sequence: Synthetic peptide
RY

SEQ ID NO: 178 - protein, 2 aa, Artificial Sequence
  Description of Artificial Sequence: Synthetic peptide
CG

SEQ ID NO: 179 - protein, 2 aa, Artificial Sequence
  Description of Artificial Sequence: Synthetic peptide
NF

SEQ ID NO: 180 - protein, 2 aa, Artificial Sequence
  Description of Artificial Sequence: Synthetic peptide
TS

SEQ ID NO: 181 - protein, 2 aa, Artificial Sequence
  Description of Artificial Sequence: Synthetic peptide
SV

SEQ ID NO: 182 - protein, 2 aa, Artificial Sequence
  Description of Artificial Sequence: Synthetic peptide
KH

SEQ ID NO: 183 - protein, 2 aa, Artificial Sequence
  Description of Artificial Sequence: Synthetic peptide
SY

SEQ ID NO: 184 - protein, 2 aa, Artificial Sequence
  Description of Artificial Sequence: Synthetic peptide
RF

SEQ ID NO: 185 - protein, 2 aa, Artificial Sequence
  Description of Artificial Sequence: Synthetic peptide
TP

SEQ ID NO: 186 - protein, 2 aa, Artificial Sequence
  Description of Artificial Sequence: Synthetic peptide
AG

SEQ ID NO: 187 - protein, 2 aa, Artificial Sequence
  Description of Artificial Sequence: Synthetic peptide
QG

SEQ ID NO: 188 - protein, 2 aa, Artificial Sequence
  Description of Artificial Sequence: Synthetic peptide
EF

SEQ ID NO: 189 - protein, 2 aa, Artificial Sequence
  Description of Artificial Sequence: Synthetic peptide
GV

SEQ ID NO: 190 - protein, 2 aa, Artificial Sequence
  Description of Artificial Sequence: Synthetic peptide
SR

SEQ ID NO: 191 - protein, 2 aa, Artificial Sequence
  Description of Artificial Sequence: Synthetic peptide
YH

SEQ ID NO: 192 - protein, 2 aa, Artificial Sequence
  Description of Artificial Sequence: Synthetic peptide
HH

SEQ ID NO: 193 - protein, 2 aa, Artificial Sequence
  Description of Artificial Sequence: Synthetic peptide
SE

SEQ ID NO: 194 - protein, 2 aa, Artificial Sequence
  Description of Artificial Sequence: Synthetic peptide
SG

SEQ ID NO: 195 - protein, 2 aa, Artificial Sequence
  Description of Artificial Sequence: Synthetic peptide
HH

SEQ ID NO: 196 - protein, 2 aa, Artificial Sequence
  Description of Artificial Sequence: Synthetic peptide
ES

SEQ ID NO: 197 - protein, 2 aa, Artificial Sequence
  Description of Artificial Sequence: Synthetic peptide
QY

SEQ ID NO: 198 - protein, 2 aa, Artificial Sequence
  Description of Artificial Sequence: Synthetic peptide
WP

SEQ ID NO: 199 - protein, 2 aa, Artificial Sequence
  Description of Artificial Sequence: Synthetic peptide
EN

SEQ ID NO: 200 - protein, 2 aa, Artificial Sequence
  Description of Artificial Sequence: Synthetic peptide
NN

SEQ ID NO: 201 - protein, 2 aa, Artificial Sequence
  Description of Artificial Sequence: Synthetic peptide
CH

SEQ ID NO: 202 - protein, 2 aa, Artificial Sequence
  Description of Artificial Sequence: Synthetic peptide
SR

SEQ ID NO: 203 - protein, 2 aa, Artificial Sequence
  Description of Artificial Sequence: Synthetic peptide
SN

SEQ ID NO: 204 - protein, 2 aa, Artificial Sequence
  Description of Artificial Sequence: Synthetic peptide
SQ

SEQ ID NO: 205 - protein, 2 aa, Artificial Sequence
  Description of Artificial Sequence: Synthetic peptide
SL

SEQ ID NO: 206 - protein, 2 aa, Artificial Sequence
  Description of Artificial Sequence: Synthetic peptide
YQ

SEQ ID NO: 207 - protein, 2 aa, Artificial Sequence
  Description of Artificial Sequence: Synthetic peptide
NH

SEQ ID NO: 208 - protein, 2 aa, Artificial Sequence
  Description of Artificial Sequence: Synthetic peptide
PA

SEQ ID NO: 209 - protein, 2 aa, Artificial Sequence
  Description of Artificial Sequence: Synthetic peptide
GE

SEQ ID NO: 210 - protein, 2 aa, Artificial Sequence
  Description of Artificial Sequence: Synthetic peptide
TG

SEQ ID NO: 211 - protein, 2 aa, Artificial Sequence
  Description of Artificial Sequence: Synthetic peptide
QF

SEQ ID NO: 212 - protein, 2 aa, Artificial Sequence
  Description of Artificial Sequence: Synthetic peptide
NY

SEQ ID NO: 213 - protein, 2 aa, Artificial Sequence
  Description of Artificial Sequence: Synthetic peptide
FT

SEQ ID NO: 214 - protein, 2 aa, Artificial Sequence
  Description of Artificial Sequence: Synthetic peptide
QS

SEQ ID NO: 215 - protein, 2 aa, Artificial Sequence
  Description of Artificial Sequence: Synthetic peptide
YN

SEQ ID NO: 216 - protein, 2 aa, Artificial Sequence
  Description of Artificial Sequence: Synthetic peptide
RN

SEQ ID NO: 217 - protein, 3 aa, Artificial Sequence
  Description of Artificial Sequence: Synthetic peptide
  MOD_RES (2)..(2): Any amino acid
SXE

SEQ ID NO: 218 - protein, 3 aa, Artificial Sequence
  Description of Artificial Sequence: Synthetic peptide
  MOD_RES (2)..(2): Any amino acid
TXE

SEQ ID NO: 219 - protein, 3 aa, Artificial Sequence
  Description of Artificial Sequence: Synthetic peptide
  MOD_RES (2)..(2): Any amino acid
SXA

SEQ ID NO: 220 - protein, 3 aa, Artificial Sequence
  Description of Artificial Sequence: Synthetic peptide
  MOD_RES (2)..(2): Any amino acid
DXA

SEQ ID NO: 221 - protein, 3 aa, Artificial Sequence
  Description of Artificial Sequence: Synthetic peptide
  MOD_RES (2)..(2): Any amino acid
TXA

SEQ ID NO: 222 - protein, 3 aa, Artificial Sequence
  Description of Artificial Sequence: Synthetic peptide
  MOD_RES (2)..(2): Any amino acid
AXG

SEQ ID NO: 223 - protein, 3 aa, Artificial Sequence
  Description of Artificial Sequence: Synthetic peptide
  MOD_RES (2)..(2): Any amino acid
NXA

SEQ ID NO: 224 - protein, 3 aa, Artificial Sequence
  Description of Artificial Sequence: Synthetic peptide
  MOD_RES (2)..(2): Any amino acid
DXS

SEQ ID NO: 225 - protein, 3 aa, Artificial Sequence
  Description of Artificial Sequence: Synthetic peptide
  MOD_RES (2)..(2): Any amino acid
NXE

SEQ ID NO: 226 - protein, 3 aa, Artificial Sequence
  Description of Artificial Sequence: Synthetic peptide
  MOD_RES (2)..(2): Any amino acid
DXR

SEQ ID NO: 227 - protein, 3 aa, Artificial Sequence
  Description of Artificial Sequence: Synthetic peptide
  MOD_RES (2)..(2): Any amino acid
SXS

SEQ ID NO: 228 - protein, 3 aa, Artificial Sequence
  Description of Artificial Sequence: Synthetic peptide
  MOD_RES (2)..(2): Any amino acid
SXQ

SEQ ID NO: 229 - protein, 3 aa, Artificial Sequence
  Description of Artificial Sequence: Synthetic peptide
  MOD_RES (2)..(2): Any amino acid
DXS

SEQ ID NO: 230 - protein, 3 aa, Artificial Sequence
  Description of Artificial Sequence: Synthetic peptide
  MOD_RES (2)..(2): Any amino acid
RXE

SEQ ID NO: 231 - protein, 3 aa, Artificial Sequence
  Description of Artificial Sequence: Synthetic peptide
  MOD_RES (2)..(2): Any amino acid
DXR

SEQ ID NO: 232 - protein, 3 aa, Artificial Sequence
  Description of Artificial Sequence: Synthetic peptide
  MOD_RES (2)..(2): Any amino acid
PXE

SEQ ID NO: 233 - protein, 3 aa, Artificial Sequence
  Description of Artificial Sequence: Synthetic peptide
  MOD_RES (2)..(2): Any amino acid
DXE

SEQ ID NO: 234 - protein, 3 aa, Artificial Sequence
  Description of Artificial Sequence: Synthetic peptide
  MOD_RES (2)..(2): Any amino acid
RXE

SEQ ID NO: 235 - protein, 3 aa, Artificial Sequence
  Description of Artificial Sequence: Synthetic peptide
  MOD_RES (2)..(2): Any amino acid
TXY

SEQ ID NO: 236 - protein, 3 aa, Artificial Sequence
  Description of Artificial Sequence: Synthetic peptide
  MOD_RES (2)..(2): Any amino acid
SXG

SEQ ID NO: 237 - protein, 3 aa, Artificial Sequence
  Description of Artificial Sequence: Synthetic peptide
  MOD_RES (2)..(2): Any amino acid
DXD

SEQ ID NO: 238 - protein, 3 aa, Artificial Sequence
  Description of Artificial Sequence: Synthetic peptide
  MOD_RES (2)..(2): Any amino acid
TXQ

SEQ ID NO: 239 - protein, 3 aa, Artificial Sequence
  Description of Artificial Sequence: Synthetic peptide
  MOD_RES (2)..(2): Any amino acid
KXG

SEQ ID NO: 240 - protein, 3 aa, Artificial Sequence
  Description of Artificial Sequence: Synthetic peptide
  MOD_RES (2)..(2): Any amino acid
EXG

SEQ ID NO: 241 - protein, 3 aa, Artificial Sequence
  Description of Artificial Sequence: Synthetic peptide
  MOD_RES (2)..(2): Any amino acid
YXG

SEQ ID NO: 242 - protein, 3 aa, Artificial Sequence
  Description of Artificial Sequence: Synthetic peptide
  MOD_RES (2)..(2): Any amino acid
SXD

SEQ ID NO: 243 - protein, 3 aa, Artificial Sequence
  Description of Artificial Sequence: Synthetic peptide
  MOD_RES (2)..(2): Any amino acid
DXQ

SEQ ID NO: 244 - protein, 3 aa, Artificial Sequence
  Description of Artificial Sequence: Synthetic peptide
  MOD_RES (2)..(2): Any amino acid
EXG

SEQ ID NO: 245 - protein, 3 aa, Artificial Sequence
  Description of Artificial Sequence: Synthetic peptide
  MOD_RES (2)..(2): Any amino acid
AXG

SEQ ID NO: 246 - protein, 3 aa, Artificial Sequence
  Description of Artificial Sequence: Synthetic peptide
  MOD_RES (2)..(2): Any amino acid
KXG

SEQ ID NO: 247 - protein, 3 aa, Artificial Sequence
  Description of Artificial Sequence: Synthetic peptide
  MOD_RES (2)..(2): Any amino acid
SXW

SEQ ID NO: 248 - protein, 3 aa, Artificial Sequence
  Description of Artificial Sequence: Synthetic peptide
  MOD_RES (2)..(2): Any amino acid
VXC

SEQ ID NO: 249 - protein, 3 aa, Artificial Sequence
  Description of Artificial Sequence: Synthetic peptide
  MOD_RES (2)..(2): Any amino acid
TXD

SEQ ID NO: 250 - protein, 3 aa, Artificial Sequence
  Description of Artificial Sequence: Synthetic peptide
  MOD_RES (2)..(2): Any amino acid
QXG

SEQ ID NO: 251 - protein, 3 aa, Artificial Sequence
  Description of Artificial Sequence: Synthetic peptide
  MOD_RES (2)..(2): Any amino acid
RXG

SEQ ID NO: 252 - protein, 3 aa, Artificial Sequence
  Description of Artificial Sequence: Synthetic peptide
  MOD_RES (2)..(2): Any amino acid
LXP

SEQ ID NO: 253 - protein, 3 aa, Artificial Sequence
  Description of Artificial Sequence: Synthetic peptide
  MOD_RES (2)..(2): Any amino acid
PXD

SEQ ID NO: 254 - protein, 3 aa, Artificial Sequence
  Description of Artificial Sequence: Synthetic peptide
  MOD_RES (2)..(2): Any amino acid
DXN

SEQ ID NO: 255 - protein, 3 aa, Artificial Sequence
  Description of Artificial Sequence: Synthetic peptide
  MOD_RES (2)..(2): Any amino acid
PXS

SEQ ID NO: 256 - protein, 3 aa, Artificial Sequence
  Description of Artificial Sequence: Synthetic peptide
  MOD_RES (2)..(2): Any amino acid
NXR

SEQ ID NO: 257 - protein, 3 aa, Artificial Sequence
  Description of Artificial Sequence: Synthetic peptide
  MOD_RES (2)..(2): Any amino acid
SXR

SEQ ID NO: 258 - protein, 3 aa, Artificial Sequence
  Description of Artificial Sequence: Synthetic peptide
  MOD_RES (2)..(2): Any amino acid
GXC

SEQ ID NO: 259 - protein, 3 aa, Artificial Sequence
  Description of Artificial Sequence: Synthetic peptide
  MOD_RES (2)..(2): Any amino acid
SXY

SEQ ID NO: 260 - protein, 3 aa, Artificial Sequence
  Description of Artificial Sequence: Synthetic peptide
  MOD_RES (2)..(2): Any amino acid
QXF

SEQ ID NO: 261 - protein, 3 aa, Artificial Sequence
  Description of Artificial Sequence: Synthetic peptide
  MOD_RES (2)..(2): Any amino acid
GXT

SEQ ID NO: 262 - protein, 3 aa, Artificial Sequence
  Description of Artificial Sequence: Synthetic peptide
  MOD_RES (2)..(2): Any amino acid
NXD

SEQ ID NO: 263 - protein, 3 aa, Artificial Sequence
  Description of Artificial Sequence: Synthetic peptide
  MOD_RES (2)..(2): Any amino acid
NXQ

SEQ ID NO: 264 - protein, 3 aa, Artificial Sequence
  Description of Artificial Sequence: Synthetic peptide
  MOD_RES (2)..(2): Any amino acid
NXN

SEQ ID NO: 265 - protein, 3 aa, Artificial Sequence
  Description of Artificial Sequence: Synthetic peptide
  MOD_RES (2)..(2): Any amino acid
QXI

SEQ ID NO: 266 - protein, 3 aa, Artificial Sequence
  Description of Artificial Sequence: Synthetic peptide
  MOD_RES (2)..(2): Any amino acid
RXD

SEQ ID NO: 267 - protein, 3 aa, Artificial Sequence
  Description of Artificial Sequence: Synthetic peptide
  MOD_RES (2)..(2): Any amino acid
RXG

SEQ ID NO: 268 - protein, 3 aa, Artificial Sequence
  Description of Artificial Sequence: Synthetic peptide
  MOD_RES (2)..(2): Any amino acid
RXY

SEQ ID NO: 269 - protein, 3 aa, Artificial Sequence
  Description of Artificial Sequence: Synthetic peptide
  MOD_RES (2)..(2): Any amino acid
PXN

SEQ ID NO: 270 - protein, 3 aa, Artificial Sequence
  Description of Artificial Sequence: Synthetic peptide
  MOD_RES (2)..(2): Any amino acid
GXP

SEQ ID NO: 271 - protein, 3 aa, Artificial Sequence
  Description of Artificial Sequence: Synthetic peptide
  MOD_RES (2)..(2): Any amino acid
SXT

SEQ ID NO: 272 - protein, 3 aa, Artificial Sequence
  Description of Artificial Sequence: Synthetic peptide
  MOD_RES (2)..(2): Any amino acid
QXN

SEQ ID NO: 273 - protein, 3 aa, Artificial Sequence
  Description of Artificial Sequence: Synthetic peptide
  MOD_RES (2)..(2): Any amino acid
DXY

SEQ ID NO: 274 - protein, 3 aa, Artificial Sequence
  Description of Artificial Sequence: Synthetic peptide
  MOD_RES (2)..(2): Any amino acid
SXN

SEQ ID NO: 275 - protein, 3 aa, Artificial Sequence
  Description of Artificial Sequence: Synthetic peptide
  MOD_RES (2)..(2): Any amino acid
DXG

SEQ ID NO: 276 - protein, 3 aa, Artificial Sequence
  Description of Artificial Sequence: Synthetic peptide
  MOD_RES (2)..(2): Any amino acid
YXY

SEQ ID NO: 277 - protein, 3 aa, Artificial Sequence
  Description of Artificial Sequence: Synthetic peptide
  MOD_RES (2)..(2): Any amino acid
NXQ

SEQ ID NO: 278 - protein, 3 aa, Artificial Sequence
  Description of Artificial Sequence: Synthetic peptide
  MOD_RES (2)..(2): Any amino acid
EXR

SEQ ID NO: 279 - protein, 3 aa, Artificial Sequence
  Description of Artificial Sequence: Synthetic peptide
  MOD_RES (2)..(2): Any amino acid
GXT

SEQ ID NO: 280 - protein, 3 aa, Artificial Sequence
  Description of Artificial Sequence: Synthetic peptide
  MOD_RES (2)..(2): Any amino acid
GXV

SEQ ID NO: 281 - protein, 3 aa, Artificial Sequence
  Description of Artificial Sequence: Synthetic peptide
  MOD_RES (2)..(2): Any amino acid
NXY

SEQ ID NO: 282 - protein, 3 aa, Artificial Sequence
  Description of Artificial Sequence: Synthetic peptide
  MOD_RES (2)..(2): Any amino acid
PXY

SEQ ID NO: 283 - protein, 3 aa, Artificial Sequence
  Description of Artificial Sequence: Synthetic peptide
  MOD_RES (2)..(2): Any amino acid
AXP

SEQ ID NO: 284 - protein, 3 aa, Artificial Sequence
  Description of Artificial Sequence: Synthetic peptide
  MOD_RES (2)..(2): Any amino acid
EXF

SEQ ID NO: 285 - protein, 3 aa, Artificial Sequence
  Description of Artificial Sequence: Synthetic peptide
  MOD_RES (2)..(2): Any amino acid
QXG

SEQ ID NO: 286 - protein, 3 aa, Artificial Sequence
  Description of Artificial Sequence: Synthetic peptide
  MOD_RES (2)..(2): Any amino acid
TXS

SEQ ID NO: 287 - protein, 3 aa, Artificial Sequence
  Description of Artificial Sequence: Synthetic peptide
  MOD_RES (2)..(2): Any amino acid
TXV

SEQ ID NO: 288 - protein, 3 aa, Artificial Sequence
  Description of Artificial Sequence: Synthetic peptide
  MOD_RES (2)..(2): Any amino acid
PXA

SEQ ID NO: 289 - protein, 3 aa, Artificial Sequence
  Description of Artificial Sequence: Synthetic peptide
  MOD_RES (2)..(2): Any amino acid
SXG

SEQ ID NO: 290 - protein, 3 aa, Artificial Sequence
  Description of Artificial Sequence: Synthetic peptide
  MOD_RES (2)..(2): Any amino acid
EXR

SEQ ID NO: 291 - protein, 3 aa, Artificial Sequence
  Description of Artificial Sequence: Synthetic peptide
  MOD_RES (2)..(2): Any amino acid
QXY

SEQ ID NO: 292 - protein, 3 aa, Artificial Sequence
  Description of Artificial Sequence: Synthetic peptide
  MOD_RES (2)..(2): Any amino acid
GXR

SEQ ID NO: 293 - protein, 3 aa, Artificial Sequence
  Description of Artificial Sequence: Synthetic peptide
  MOD_RES (2)..(2): Any amino acid
DXR

SEQ ID NO: 294 - protein, 3 aa, Artificial Sequence
  Description of Artificial Sequence: Synthetic peptide
  MOD_RES (2)..(2): Any amino acid
LXA

SEQ ID NO: 295 - protein, 3 aa, Artificial Sequence
  Description of Artificial Sequence: Synthetic peptide
  MOD_RES (2)..(2): Any amino acid
DXG

SEQ ID NO: 296 - protein, 3 aa, Artificial Sequence
  Description of Artificial Sequence: Synthetic peptide
  MOD_RES (2)..(2): Any amino acid
CXP

SEQ ID NO: 297 - protein, 3 aa, Artificial Sequence
  Description of Artificial Sequence: Synthetic peptide
  MOD_RES (2)..(2): Any amino acid
YXY

SEQ ID NO: 298 - protein, 3 aa, Artificial Sequence
  Description of Artificial Sequence: Synthetic peptide
  MOD_RES (2)..(2): Any amino acid
NXS

SEQ ID NO: 299 - protein, 3 aa, Artificial Sequence
  Description of Artificial Sequence: Synthetic peptide
  MOD_RES (2)..(2): Any amino acid
RXP

SEQ ID NO: 300 - protein, 3 aa, Artificial Sequence
  Description of Artificial Sequence: Synthetic peptide
  MOD_RES (2)..(2): Any amino acid
DXT

SEQ ID NO: 301 - protein, 3 aa, Artificial Sequence
  Description of Artificial Sequence: Synthetic peptide
  MOD_RES (2)..(2): Any amino acid
TXK

SEQ ID NO: 302 - protein, 3 aa, Artificial Sequence
  Description of Artificial Sequence: Synthetic peptide
  MOD_RES (2)..(2): Any amino acid
DXN

SEQ ID NO: 303 - protein, 3 aa, Artificial Sequence
  Description of Artificial Sequence: Synthetic peptide
  MOD_RES (2)..(2): Any amino acid
GXC

SEQ ID NO: 304 - protein, 3 aa, Artificial Sequence
  Description of Artificial Sequence: Synthetic peptide
  MOD_RES (2)..(2): Any amino acid
WXG

SEQ ID NO: 305 - protein, 3 aa, Artificial Sequence
  Description of Artificial Sequence: Synthetic peptide
  MOD_RES (2)..(2): Any amino acid
RXF

SEQ ID NO: 306 - protein, 3 aa, Artificial Sequence
  Description of Artificial Sequence: Synthetic peptide
  MOD_RES (2)..(2): Any amino acid
NXQ

SEQ ID NO: 307 - protein, 3 aa, Artificial Sequence
  Description of Artificial Sequence: Synthetic peptide
  MOD_RES (2)..(2): Any amino acid
NXG

SEQ ID NO: 308 - protein, 3 aa, Artificial Sequence
  Description of Artificial Sequence: Synthetic peptide
  MOD_RES (2)..(2): Any amino acid
NXG

SEQ ID NO: 309 - protein, 3 aa, Artificial Sequence
  Description of Artificial Sequence: Synthetic peptide
  MOD_RES (2)..(2): Any amino acid
DXY

SEQ ID NO: 310 - protein, 3 aa, Artificial Sequence
  Description of Artificial Sequence: Synthetic peptide
  MOD_RES (2)..(2): Any amino acid
DXR

SEQ ID NO: 311 - protein, 3 aa, Artificial Sequence
  Description of Artificial Sequence: Synthetic peptide
  MOD_RES (2)..(2): Any amino acid
GXW

SEQ ID NO: 312 - protein, 3 aa, Artificial Sequence
  Description of Artificial Sequence: Synthetic peptide
  MOD_RES (2)..(2): Any amino acid
YXE

SEQ ID NO: 313 - protein, 3 aa, Artificial Sequence
  Description of Artificial Sequence: Synthetic peptide
  MOD_RES (2)..(2): Any amino acid
SXN

SEQ ID NO: 314 - protein, 3 aa, Artificial Sequence
  Description of Artificial Sequence: Synthetic peptide
  MOD_RES (2)..(2): Any amino acid
VXK

SEQ ID NO: 315 - protein, 3 aa, Artificial Sequence
  Description of Artificial Sequence: Synthetic peptide
  MOD_RES (2)..(2): Any amino acid
EXR

SEQ ID NO: 316 - protein, 3 aa, Artificial Sequence
  Description of Artificial Sequence: Synthetic peptide
VGK

SEQ ID NO: 317 - protein, 3 aa, Artificial Sequence
  Description of Artificial Sequence: Synthetic peptide
GKT

SEQ ID NO: 318 - protein, 3 aa, Artificial Sequence
  Description of Artificial Sequence: Synthetic peptide
AGK

SEQ ID NO: 319 - protein, 3 aa, Artificial Sequence
  Description of Artificial Sequence: Synthetic peptide
GKS

SEQ ID NO: 320 - protein, 3 aa, Artificial Sequence
  Description of Artificial Sequence: Synthetic peptide
SGK

SEQ ID NO: 321 - protein, 3 aa, Artificial Sequence
  Description of Artificial Sequence: Synthetic peptide
TGK

SEQ ID NO: 322 - protein, 3 aa, Artificial Sequence
  Description of Artificial Sequence: Synthetic peptide
SCW

SEQ ID NO: 323 - protein, 3 aa, Artificial Sequence
  Description of Artificial Sequence: Synthetic peptide
KTT

SEQ ID NO: 324 - protein, 3 aa, Artificial Sequence
  Description of Artificial Sequence: Synthetic peptide
GLG

SEQ ID NO: 325 - protein, 3 aa, Artificial Sequence
  Description of Artificial Sequence: Synthetic peptide
VAC

SEQ ID NO: 326 - protein, 3 aa, Artificial Sequence
  Description of Artificial Sequence: Synthetic peptide
ACK

SEQ ID NO: 327 - protein, 3 aa, Artificial Sequence
  Description of Artificial Sequence: Synthetic peptide
STK

SEQ ID NO: 328 - protein, 3 aa, Artificial Sequence
  Description of Artificial Sequence: Synthetic peptide
NVA

SEQ ID NO: 329 - protein, 3 aa, Artificial Sequence
  Description of Artificial Sequence: Synthetic peptide
SWG

SEQ ID NO: 330 - protein, 3 aa, Artificial Sequence
  Description of Artificial Sequence: Synthetic peptide
LCT

SEQ ID NO: 331 - protein, 3 aa, Artificial Sequence
  Description of Artificial Sequence: Synthetic peptide
CKN

SEQ ID NO: 332 - protein, 3 aa, Artificial Sequence
  Description of Artificial Sequence: Synthetic peptide
AAG

SEQ ID NO: 333 - protein, 3 aa, Artificial Sequence
  Description of Artificial Sequence: Synthetic peptide
TEA

SEQ ID NO: 334 - protein, 3 aa, Artificial Sequence
  Description of Artificial Sequence: Synthetic peptide
SAA

SEQ ID NO: 335 - protein, 3 aa, Artificial Sequence
  Description of Artificial Sequence: Synthetic peptide
ACW

SEQ ID NO: 336 - protein, 3 aa, Artificial Sequence
  Description of Artificial Sequence: Synthetic peptide
TNS

SEQ ID NO: 337 - protein, 3 aa, Artificial Sequence
  Description of Artificial Sequence: Synthetic peptide
GLP

SEQ ID NO: 338 - protein, 3 aa, Artificial Sequence
  Description of Artificial Sequence: Synthetic peptide
NIF

SEQ ID NO: 339 - protein, 3 aa, Artificial Sequence
  Description of Artificial Sequence: Synthetic peptide
SIP

SEQ ID NO: 340 - protein, 3 aa, Artificial Sequence
  Description of Artificial Sequence: Synthetic peptide
WCG

SEQ ID NO: 341 - protein, 3 aa, Artificial Sequence
  Description of Artificial Sequence: Synthetic peptide
FPG

SEQ ID NO: 342 - protein, 3 aa, Artificial Sequence
  Description of Artificial Sequence: Synthetic peptide
GFT

SEQ ID NO: 343 - protein, 3 aa, Artificial Sequence
  Description of Artificial Sequence: Synthetic peptide
FTN

SEQ ID NO: 344 - protein, 3 aa, Artificial Sequence
  Description of Artificial Sequence: Synthetic peptide
QFN

SEQ ID NO: 345 - protein, 3 aa, Artificial Sequence
  Description of Artificial Sequence: Synthetic peptide
PGP

SEQ ID NO: 346 - protein, 3 aa, Artificial Sequence
  Description of Artificial Sequence: Synthetic peptide
CSA

SEQ ID NO: 347 - protein, 3 aa, Artificial Sequence
  Description of Artificial Sequence: Synthetic peptide
NHG

SEQ ID NO: 348 - protein, 3 aa, Artificial Sequence
  Description of Artificial Sequence: Synthetic peptide
PTW

SEQ ID NO: 349 - protein, 3 aa, Artificial Sequence
  Description of Artificial Sequence: Synthetic peptide
SRW

SEQ ID NO: 350 - protein, 3 aa, Artificial Sequence
  Description of Artificial Sequence: Synthetic peptide
MDS

SEQ ID NO: 351 - protein, 3 aa, Artificial Sequence
  Description of Artificial Sequence: Synthetic peptide
STM

SEQ ID NO: 352 - protein, 3 aa, Artificial Sequence
  Description of Artificial Sequence: Synthetic peptide
CGP

SEQ ID NO: 353 - protein, 3 aa, Artificial Sequence
  Description of Artificial Sequence: Synthetic peptide
AGP

SEQ ID NO: 354 - protein, 3 aa, Artificial Sequence
  Description of Artificial Sequence: Synthetic peptide
GSC

SEQ ID NO: 355 - protein, 3 aa, Artificial Sequence
  Description of Artificial Sequence: Synthetic peptide
TKV

SEQ ID NO: 356 - protein, 3 aa, Artificial Sequence
  Description of Artificial Sequence: Synthetic peptide
TVA

SEQ ID NO: 357 - protein, 3 aa, Artificial Sequence
  Description of Artificial Sequence: Synthetic peptide
QGQ

SEQ ID NO: 358 - protein, 3 aa, Artificial Sequence
  Description of Artificial Sequence: Synthetic peptide
SVT

SEQ ID NO: 359 - protein, 3 aa, Artificial Sequence
  Description of Artificial Sequence: Synthetic peptide
YPS

SEQ ID NO: 360 - protein, 3 aa, Artificial Sequence
  Description of Artificial Sequence: Synthetic peptide
LSA

SEQ ID NO: 361 - protein, 3 aa, Artificial Sequence
  Description of Artificial Sequence: Synthetic peptide
TPG

SEQ ID NO: 362 - protein, 3 aa, Artificial Sequence
  Description of Artificial Sequence: Synthetic peptide
GSC

SEQ ID NO: 363 - protein, 3 aa, Artificial Sequence
  Description of Artificial Sequence: Synthetic peptide
KVD

SEQ ID NO: 364 - protein, 3 aa, Artificial Sequence
  Description of Artificial Sequence: Synthetic peptide
VNG

SEQ ID NO: 365 - protein, 3 aa, Artificial Sequence
  Description of Artificial Sequence: Synthetic peptide
NHA

SEQ ID NO: 366 - protein, 3 aa, Artificial Sequence
  Description of Artificial Sequence: Synthetic peptide
DAC

SEQ ID NO: 367 - protein, 3 aa, Artificial Sequence
  Description of Artificial Sequence: Synthetic peptide
PTE

SEQ ID NO: 368 - protein, 3 aa, Artificial Sequence
  Description of Artificial Sequence: Synthetic peptide
VNT

SEQ ID NO: 369 - protein, 3 aa, Artificial Sequence
  Description of Artificial Sequence: Synthetic peptide
QRG

SEQ ID NO: 370 - protein, 3 aa, Artificial Sequence
  Description of Artificial Sequence: Synthetic peptide
DRC

SEQ ID NO: 371 - protein, 3 aa, Artificial Sequence
  Description of Artificial Sequence: Synthetic peptide
TPN

SEQ ID NO: 372 - protein, 3 aa, Artificial Sequence
  Description of Artificial Sequence: Synthetic peptide
QSP

SEQ ID NO: 373 - protein, 3 aa, Artificial Sequence
  Description of Artificial Sequence: Synthetic peptide
NPT

SEQ ID NO: 374 - protein, 3 aa, Artificial Sequence
  Description of Artificial Sequence: Synthetic peptide
PGA

SEQ ID NO: 375 - protein, 3 aa, Artificial Sequence
  Description of Artificial Sequence: Synthetic peptide
TMS

SEQ ID NO: 376 - protein, 3 aa, Artificial Sequence
  Description of Artificial Sequence: Synthetic peptide
WNI

SEQ ID NO: 377 - protein, 3 aa, Artificial Sequence
  Description of Artificial Sequence: Synthetic peptide
SLP

SEQ ID NO: 378 - protein, 3 aa, Artificial Sequence
  Description of Artificial Sequence: Synthetic peptide
VWG

SEQ ID NO: 379 - protein, 3 aa, Artificial Sequence
  Description of Artificial Sequence: Synthetic peptide
YAS

SEQ ID NO: 380 - protein, 3 aa, Artificial Sequence
  Description of Artificial Sequence: Synthetic peptide
ETG

SEQ ID NO: 381 - protein, 3 aa, Artificial Sequence
  Description of Artificial Sequence: Synthetic peptide
DGR

SEQ ID NO: 382 - protein, 3 aa, Artificial Sequence
  Description of Artificial Sequence: Synthetic peptide
PGD

SEQ ID NO: 383 - protein, 3 aa, Artificial Sequence
  Description of Artificial Sequence: Synthetic peptide
KYG

SEQ ID NO: 384 - protein, 3 aa, Artificial Sequence
  Description of Artificial Sequence: Synthetic peptide
PNR

SEQ ID NO: 385 - protein, 3 aa, Artificial Sequence
  Description of Artificial Sequence: Synthetic peptide
YRG

SEQ ID NO: 386 - protein, 3 aa, Artificial Sequence
  Description of Artificial Sequence: Synthetic peptide
LPP

SEQ ID NO: 387 - protein, 3 aa, Artificial Sequence
  Description of Artificial Sequence: Synthetic peptide
ALG

SEQ ID NO: 388 - protein, 3 aa, Artificial Sequence
  Description of Artificial Sequence: Synthetic peptide
LPP

SEQ ID NO: 389 - protein, 3 aa, Artificial Sequence
  Description of Artificial Sequence: Synthetic peptide
VPG

SEQ ID NO: 390 - protein, 3 aa, Artificial Sequence
  Description of Artificial Sequence: Synthetic peptide
GLN

SEQ ID NO: 391 - protein, 3 aa, Artificial Sequence
  Description of Artificial Sequence: Synthetic peptide
DGS

SEQ ID NO: 392 - protein, 3 aa, Artificial Sequence
  Description of Artificial Sequence: Synthetic peptide
TQA

SEQ ID NO: 393 - protein, 3 aa, Artificial Sequence
  Description of Artificial Sequence: Synthetic peptide
LGF

SEQ ID NO: 394 - protein, 3 aa, Artificial Sequence
  Description of Artificial Sequence: Synthetic peptide
VGS

SEQ ID NO: 395 - protein, 3 aa, Artificial Sequence
  Description of Artificial Sequence: Synthetic peptide
VGG

SEQ ID NO: 396 - protein, 3 aa, Artificial Sequence
  Description of Artificial Sequence: Synthetic peptide
DAG

SEQ ID NO: 397 - protein, 3 aa, Artificial Sequence
  Description of Artificial Sequence: Synthetic peptide
NFQ

SEQ ID NO: 398 - protein, 3 aa, Artificial Sequence
  Description of Artificial Sequence: Synthetic peptide
PLP

SEQ ID NO: 399 - protein, 3 aa, Artificial Sequence
  Description of Artificial Sequence: Synthetic peptide
GVG

SEQ ID NO: 400 - protein, 3 aa, Artificial Sequence
  Description of Artificial Sequence: Synthetic peptide
KST

SEQ ID NO: 401 - protein, 3 aa, Artificial Sequence
  Description of Artificial Sequence: Synthetic peptide
GVC

SEQ ID NO: 402 - protein, 3 aa, Artificial Sequence
  Description of Artificial Sequence: Synthetic peptide
LNH

SEQ ID NO: 403 - protein, 3 aa, Artificial Sequence
  Description of Artificial Sequence: Synthetic peptide
FNT

SEQ ID NO: 404 - protein, 3 aa, Artificial Sequence
  Description of Artificial Sequence: Synthetic peptide
AFG

SEQ ID NO: 405 - protein, 3 aa, Artificial Sequence
  Description of Artificial Sequence: Synthetic peptide
YDY

SEQ ID NO: 406 - protein, 3 aa, Artificial Sequence
  Description of Artificial Sequence: Synthetic peptide
EFG

SEQ ID NO: 407 - protein, 3 aa, Artificial Sequence
  Description of Artificial Sequence: Synthetic peptide
GAD

SEQ ID NO: 408 - protein, 3 aa, Artificial Sequence
  Description of Artificial Sequence: Synthetic peptide
PGY

SEQ ID NO: 409 - protein, 3 aa, Artificial Sequence
  Description of Artificial Sequence: Synthetic peptide
VSG

SEQ ID NO: 410 - protein, 3 aa, Artificial Sequence
  Description of Artificial Sequence: Synthetic peptide
VPS

SEQ ID NO: 411 - protein, 3 aa, Artificial Sequence
  Description of Artificial Sequence: Synthetic peptide
NTK

SEQ ID NO: 412 - protein, 3 aa, Artificial Sequence
  Description of Artificial Sequence: Synthetic peptide
KEG

SEQ ID NO: 413 - protein, 3 aa, Artificial Sequence
  Description of Artificial Sequence: Synthetic peptide
ERG

SEQ ID NO: 414 - protein, 3 aa, Artificial Sequence
  Description of Artificial Sequence: Synthetic peptide
TGN

SEQ ID NO: 415 - protein, 4 aa, Artificial Sequence
  Description of Artificial Sequence: Synthetic peptide
  MOD_RES (2)..(3): Any amino acid
EXXR

SEQ ID NO: 416 - protein, 4 aa, Artificial Sequence
  Description of Artificial Sequence: Synthetic peptide
  MOD_RES (2)..(3): Any amino acid
DXXR

SEQ ID NO: 417 - protein, 4 aa, Artificial Sequence
  Description of Artificial Sequence: Synthetic peptide
  MOD_RES (2)..(3): Any amino acid
AXXR

SEQ ID NO: 418 - protein, 4 aa, Artificial Sequence
  Description of Artificial Sequence: Synthetic peptide
  MOD_RES (2)..(3): Any amino acid
QXXR

SEQ ID NO: 419 - protein, 4 aa, Artificial Sequence
  Description of Artificial Sequence: Synthetic peptide
  MOD_RES (2)..(3): Any amino acid
RXXE

SEQ ID NO: 420 - protein, 4 aa, Artificial Sequence
  Description of Artificial Sequence: Synthetic peptide
  MOD_RES (2)..(3): Any amino acid
SXXE

SEQ ID NO: 421 - protein, 4 aa, Artificial Sequence
  Description of Artificial Sequence: Synthetic peptide
  MOD_RES (2)..(3): Any amino acid
TXXE

SEQ ID NO: 422 - protein, 4 aa, Artificial Sequence
  Description of Artificial Sequence: Synthetic peptide
  MOD_RES (2)..(3): Any amino acid
RXXR

SEQ ID NO: 423 - protein, 4 aa, Artificial Sequence
  Description of Artificial Sequence: Synthetic peptide
  MOD_RES (2)..(3): Any amino acid
NXXR

SEQ ID NO: 424 - protein, 4 aa, Artificial Sequence
  Description of Artificial Sequence: Synthetic peptide
  MOD_RES (2)..(3): Any amino acid
EXXL

SEQ ID NO: 425 - protein, 4 aa, Artificial Sequence
  Description of Artificial Sequence: Synthetic peptide
  MOD_RES (2)..(3): Any amino acid
EXXE

SEQ ID NO: 426 - protein, 4 aa, Artificial Sequence
  Description of Artificial Sequence: Synthetic peptide
  MOD_RES (2)..(3): Any amino acid
RXXQ

SEQ ID NO: 427 - protein, 4 aa, Artificial Sequence
  Description of Artificial Sequence: Synthetic peptide
  MOD_RES (2)..(3): Any amino acid
AXXA

SEQ ID NO: 428 - protein, 4 aa, Artificial Sequence
  Description of Artificial Sequence: Synthetic peptide
  MOD_RES (2)..(3): Any amino acid
LXXQ

SEQ ID NO: 429 - protein, 4 aa, Artificial Sequence
  Description of Artificial Sequence: Synthetic peptide
  MOD_RES (2)..(3): Any amino acid
TXXQ

SEQ ID NO: 430 - protein, 4 aa, Artificial Sequence
  Description of Artificial Sequence: Synthetic peptide
  MOD_RES (2)..(3): Any amino acid
LXXE

SEQ ID NO: 431 - protein, 4 aa, Artificial Sequence
  Description of Artificial Sequence: Synthetic peptide
  MOD_RES (2)..(3): Any amino acid
SXXR

SEQ ID NO: 432 - protein, 4 aa, Artificial Sequence
  Description of Artificial Sequence: Synthetic peptide
  MOD_RES (2)..(3): Any amino acid
PXXR

SEQ ID NO: 433 - protein, 4 aa, Artificial Sequence
  Description of Artificial Sequence: Synthetic peptide
  MOD_RES (2)..(3): Any amino acid
EXXK

SEQ ID NO: 434 - protein, 4 aa, Artificial Sequence
  Description of Artificial Sequence: Synthetic peptide
  MOD_RES (2)..(3): Any amino acid
EXXG

SEQ ID NO: 435 - protein, 4 aa, Artificial Sequence
  Description of Artificial Sequence: Synthetic peptide
  MOD_RES (2)..(3): Any amino acid
NXXE

SEQ ID NO: 436 - protein, 4 aa, Artificial Sequence
  Description of Artificial Sequence: Synthetic peptide
  MOD_RES (2)..(3): Any amino acid
AXXG

SEQ ID NO: 437 - protein, 4 aa, Artificial Sequence
  Description of Artificial Sequence: Synthetic peptide
  MOD_RES (2)..(3): Any amino acid
EXXH

SEQ ID NO: 438 - protein, 4 aa, Artificial Sequence
  Description of Artificial Sequence: Synthetic peptide
  MOD_RES (2)..(3): Any amino acid
EXXA

SEQ ID NO: 439 - protein, 4 aa, Artificial Sequence
  Description of Artificial Sequence: Synthetic peptide
  MOD_RES (2)..(3): Any amino acid
QXXE

SEQ ID NO: 440 - protein, 4 aa, Artificial Sequence
  Description of Artificial Sequence: Synthetic peptide
  MOD_RES (2)..(3): Any amino acid
AXXQ

SEQ ID NO: 441 - protein, 4 aa, Artificial Sequence
  Description of Artificial Sequence: Synthetic peptide
  MOD_RES (2)..(3): Any amino acid
QXXQ

SEQ ID NO: 442 - protein, 4 aa, Artificial Sequence
  Description of Artificial Sequence: Synthetic peptide
  MOD_RES (2)..(3): Any amino acid
SXXQ

SEQ ID NO: 443 - protein, 4 aa, Artificial Sequence
  Description of Artificial Sequence: Synthetic peptide
  MOD_RES (2)..(3): Any amino acid
QXXA

SEQ ID NO: 444 - protein, 4 aa, Artificial Sequence
  Description of Artificial Sequence: Synthetic peptide
  MOD_RES (2)..(3): Any amino acid
AXXE

SEQ ID NO: 445 - protein, 4 aa, Artificial Sequence
  Description of Artificial Sequence: Synthetic peptide
  MOD_RES (2)..(3): Any amino acid
EXXN

SEQ ID NO: 446 - protein, 4 aa, Artificial Sequence
  Description of Artificial Sequence: Synthetic peptide
  MOD_RES (2)..(3): Any amino acid
QXXL

SEQ ID NO: 447 - protein, 4 aa, Artificial Sequence
  Description of Artificial Sequence: Synthetic peptide
  MOD_RES (2)..(3): Any amino acid
QXXK

SEQ ID NO: 448 - protein, 4 aa, Artificial Sequence
  Description of Artificial Sequence: Synthetic peptide
  MOD_RES (2)..(3): Any amino acid
KXXG

SEQ ID NO: 449 - protein, 4 aa, Artificial Sequence
  Description of Artificial Sequence: Synthetic peptide
  MOD_RES (2)..(3): Any amino acid
NXXQ

SEQ ID NO: 450 - protein, 4 aa, Artificial Sequence
  Description of Artificial Sequence: Synthetic peptide
  MOD_RES (2)..(3): Any amino acid
SXXQ

SEQ ID NO: 451 - protein, 4 aa, Artificial Sequence
  Description of Artificial Sequence: Synthetic peptide
  MOD_RES (2)..(3): Any amino acid
RXXG

SEQ ID NO: 452 - protein, 4 aa, Artificial Sequence
  Description of Artificial Sequence: Synthetic peptide
  MOD_RES (2)..(3): Any amino acid
SXXD

SEQ ID NO: 453 - protein, 4 aa, Artificial Sequence
  Description of Artificial Sequence: Synthetic peptide
  MOD_RES (2)..(3): Any amino acid
DXXE

SEQ ID NO: 454 - protein, 4 aa, Artificial Sequence
  Description of Artificial Sequence: Synthetic peptide
  MOD_RES (2)..(3): Any amino acid
EXXQ

SEQ ID NO: 455 - protein, 4 aa, Artificial Sequence
  Description of Artificial Sequence: Synthetic peptide
  MOD_RES (2)..(3): Any amino acid
GXXT

SEQ ID NO: 456 - protein, 4 aa, Artificial Sequence
  Description of Artificial Sequence: Synthetic peptide
  MOD_RES (2)..(3): Any amino acid
YXXE

SEQ ID NO: 457 - protein, 4 aa, Artificial Sequence
  Description of Artificial Sequence: Synthetic peptide
  MOD_RES (2)..(3): Any amino acid
NXXN

SEQ ID NO: 458 - protein, 4 aa, Artificial Sequence
  Description of Artificial Sequence: Synthetic peptide
  MOD_RES (2)..(3): Any amino acid
EXXR

SEQ ID NO: 459 - protein, 4 aa, Artificial Sequence
  Description of Artificial Sequence: Synthetic peptide
  MOD_RES (2)..(3): Any amino acid
QXXG

SEQ ID NO: 460 - protein, 4 aa, Artificial Sequence
  Description of Artificial Sequence: Synthetic peptide
  MOD_RES (2)..(3): Any amino acid
TXXR

SEQ ID NO: 461 - protein, 4 aa, Artificial Sequence
  Description of Artificial Sequence: Synthetic peptide
  MOD_RES (2)..(3): Any amino acid
DXXE

SEQ ID NO: 462 - protein, 4 aa, Artificial Sequence
  Description of Artificial Sequence: Synthetic peptide
  MOD_RES (2)..(3): Any amino acid
YXXQ

SEQ ID NO: 463 - protein, 4 aa, Artificial Sequence
  Description of Artificial Sequence: Synthetic peptide
  MOD_RES (2)..(3): Any amino acid
QXXN

SEQ ID NO: 464 - protein, 4 aa, Artificial Sequence
  Description of Artificial Sequence: Synthetic peptide
  MOD_RES (2)..(3): Any amino acid
DXXG

SEQ ID NO: 465 - protein, 4 aa, Artificial Sequence
  Description of Artificial Sequence: Synthetic peptide
  MOD_RES (2)..(3): Any amino acid
WXXE

SEQ ID NO: 466 - protein, 4 aa, Artificial Sequence
  Description of Artificial Sequence: Synthetic peptide
  MOD_RES (2)..(3): Any amino acid
EXXD

SEQ ID NO: 467 - protein, 4 aa, Artificial Sequence
  Description of Artificial Sequence: Synthetic peptide
  MOD_RES (2)..(3): Any amino acid
HXXR

SEQ ID NO: 468 - protein, 4 aa, Artificial Sequence
  Description of Artificial Sequence: Synthetic peptide
  MOD_RES (2)..(3): Any amino acid
DXXL

SEQ ID NO: 469 - protein, 4 aa, Artificial Sequence
  Description of Artificial Sequence: Synthetic peptide
  MOD_RES (2)..(3): Any amino acid
EXXG

SEQ ID NO: 470 - protein, 4 aa, Artificial Sequence
  Description of Artificial Sequence: Synthetic peptide
  MOD_RES (2)..(3): Any amino acid
EXXS

SEQ ID NO: 471 - protein, 4 aa, Artificial Sequence
  Description of Artificial Sequence: Synthetic peptide
  MOD_RES (2)..(3): Any amino acid
QXXI

SEQ ID NO: 472 - protein, 4 aa, Artificial Sequence
  Description of Artificial Sequence: Synthetic peptide
  MOD_RES (2)..(3): Any amino acid
DXXA

SEQ ID NO: 473 - protein, 4 aa, Artificial Sequence
  Description of Artificial Sequence: Synthetic peptide
  MOD_RES (2)..(3): Any amino acid
SXXG

SEQ ID NO: 474 - protein, 4 aa, Artificial Sequence
  Description of Artificial Sequence: Synthetic peptide
  MOD_RES (2)..(3): Any amino acid
AXXD

SEQ ID NO: 475 - protein, 4 aa, Artificial Sequence
  Description of Artificial Sequence: Synthetic peptide
  MOD_RES (2)..(3): Any amino acid
HXXN

SEQ ID NO: 476 - protein, 4 aa, Artificial Sequence
  Description of Artificial Sequence: Synthetic peptide
  MOD_RES (2)..(3): Any amino acid
DXXQ

SEQ ID NO: 477 - protein, 4 aa, Artificial Sequence
  Description of Artificial Sequence: Synthetic peptide
  MOD_RES (2)..(3): Any amino acid
KXXR

SEQ ID NO: 478 - protein, 4 aa, Artificial Sequence
  Description of Artificial Sequence: Synthetic peptide
  MOD_RES (2)..(3): Any amino acid
KXXE

SEQ ID NO: 479 - protein, 4 aa, Artificial Sequence
  Description of Artificial Sequence: Synthetic peptide
  MOD_RES (2)..(3): Any amino acid
EXXY

SEQ ID NO: 480 - protein, 4 aa, Artificial Sequence
  Description of Artificial Sequence: Synthetic peptide
  MOD_RES (2)..(3): Any amino acid
DXXS

SEQ ID NO: 481 - protein, 4 aa, Artificial Sequence
  Description of Artificial Sequence: Synthetic peptide
  MOD_RES (2)..(3): Any amino acid
RXXE

SEQ ID NO: 482 - protein, 4 aa, Artificial Sequence
  Description of Artificial Sequence: Synthetic peptide
  MOD_RES (2)..(3): Any amino acid
NXXA

SEQ ID NO: 483 - protein, 4 aa, Artificial Sequence
  Description of Artificial Sequence: Synthetic peptide
  MOD_RES (2)..(3): Any amino acid
RXXG

SEQ ID NO: 484 - protein, 4 aa, Artificial Sequence
  Description of Artificial Sequence: Synthetic peptide
  MOD_RES (2)..(3): Any amino acid
NXXD

SEQ ID NO: 485 - protein, 4 aa, Artificial Sequence
  Description of Artificial Sequence: Synthetic peptide
  MOD_RES (2)..(3): Any amino acid
DXXQ

SEQ ID NO: 486 - protein, 4 aa, Artificial Sequence
  Description of Artificial Sequence: Synthetic peptide
  MOD_RES (2)..(3): Any amino acid
NXXL

SEQ ID NO: 487 - protein, 4 aa, Artificial Sequence
  Description of Artificial Sequence: Synthetic peptide
  MOD_RES (2)..(3): Any amino acid
HXXE

SEQ ID NO: 488 - protein, 4 aa, Artificial Sequence
  Description of Artificial Sequence: Synthetic peptide
  MOD_RES (2)..(3): Any amino acid
GXXE

SEQ ID NO: 489 - protein, 4 aa, Artificial Sequence
  Description of Artificial Sequence: Synthetic peptide
  MOD_RES (2)..(3): Any amino acid
NXXQ

SEQ ID NO: 490 - protein, 4 aa, Artificial Sequence
  Description of Artificial Sequence: Synthetic peptide
  MOD_RES (2)..(3): Any amino acid
PXXQ

SEQ ID NO: 491 - protein, 4 aa, Artificial Sequence
  Description of Artificial Sequence: Synthetic peptide
  MOD_RES (2)..(3): Any amino acid
DXXI

SEQ ID NO: 492 - protein, 4 aa, Artificial Sequence
  Description of Artificial Sequence: Synthetic peptide
  MOD_RES (2)..(3): Any amino acid
DXXN

SEQ ID NO: 493 - protein, 4 aa, Artificial Sequence
  Description of Artificial Sequence: Synthetic peptide
  MOD_RES (2)..(3): Any amino acid
PXXQ

SEQ ID NO: 494 - protein, 4 aa, Artificial Sequence
  Description of Artificial Sequence: Synthetic peptide
  MOD_RES (2)..(3): Any amino acid
AXXS

SEQ ID NO: 495 - protein, 4 aa, Artificial Sequence
  Description of Artificial Sequence: Synthetic peptide
  MOD_RES (2)..(3): Any amino acid
PXXE

SEQ ID NO: 496 - protein, 4 aa, Artificial Sequence
  Description of Artificial Sequence: Synthetic peptide
  MOD_RES (2)..(3): Any amino acid
LXXR

SEQ ID NO: 497 - protein, 4 aa, Artificial Sequence
  Description of Artificial Sequence: Synthetic peptide
  MOD_RES (2)..(3): Any amino acid
DXXD

SEQ ID NO: 498 - protein, 4 aa, Artificial Sequence
  Description of Artificial Sequence: Synthetic peptide
  MOD_RES (2)..(3): Any amino acid
NXXN

SEQ ID NO: 499 - protein, 4 aa, Artificial Sequence
  Description of Artificial Sequence: Synthetic peptide
  MOD_RES (2)..(3): Any amino acid
DXXR

SEQ ID NO: 500 - protein, 4 aa, Artificial Sequence
  Description of Artificial Sequence: Synthetic peptide
  MOD_RES (2)..(3): Any amino acid
NXXA

SEQ ID NO: 501 - protein, 4 aa, Artificial Sequence
  Description of Artificial Sequence: Synthetic peptide
  MOD_RES (2)..(3): Any amino acid
YXXR

SEQ ID NO: 502 - protein, 4 aa, Artificial Sequence
  Description of Artificial Sequence: Synthetic peptide
  MOD_RES (2)..(3): Any amino acid
DXXL

SEQ ID NO: 503 - protein, 4 aa, Artificial Sequence
  Description of Artificial Sequence: Synthetic peptide
  MOD_RES (2)..(3): Any amino acid
QXXY

SEQ ID NO: 504 - protein, 4 aa, Artificial Sequence
  Description of Artificial Sequence: Synthetic peptide
  MOD_RES (2)..(3): Any amino acid
DXXT

SEQ ID NO: 505 - protein, 4 aa, Artificial Sequence
  Description of Artificial Sequence: Synthetic peptide
  MOD_RES (2)..(3): Any amino acid
CXXC

SEQ ID NO: 506 - protein, 4 aa, Artificial Sequence
  Description of Artificial Sequence: Synthetic peptide
  MOD_RES (2)..(3): Any amino acid
PXXL

SEQ ID NO: 507 - protein, 4 aa, Artificial Sequence
  Description of Artificial Sequence: Synthetic peptide
  MOD_RES (2)..(3): Any amino acid
DXXY

SEQ ID NO: 508 - protein, 4 aa, Artificial Sequence
  Description of Artificial Sequence: Synthetic peptide
  MOD_RES (2)..(3): Any amino acid
KXXG

SEQ ID NO: 509 - protein, 4 aa, Artificial Sequence
  Description of Artificial Sequence: Synthetic peptide
  MOD_RES (2)..(3): Any amino acid
RXXD

SEQ ID NO: 510 - protein, 4 aa, Artificial Sequence
  Description of Artificial Sequence: Synthetic peptide
  MOD_RES (2)..(3): Any amino acid
RXXG

SEQ ID NO: 511 - protein, 4 aa, Artificial Sequence
  Description of Artificial Sequence: Synthetic peptide
  MOD_RES (2)..(3): Any amino acid
GXXS

SEQ ID NO: 512 - protein, 4 aa, Artificial Sequence
  Description of Artificial Sequence: Synthetic peptide
  MOD_RES (2)..(3): Any amino acid
DXXA

SEQ ID NO: 513 - protein, 4 aa, Artificial Sequence
  Description of Artificial Sequence: Synthetic peptide
  MOD_RES (2)..(3): Any amino acid
RXXQ

SEQ ID NO: 514 - protein, 4 aa, Artificial Sequence
  Description of Artificial Sequence: Synthetic peptide
  MOD_RES (2)..(2): Any amino acid
GXGK

SEQ ID NO: 515 - protein, 4 aa, Artificial Sequence
  Description of Artificial Sequence: Synthetic peptide
  MOD_RES (2)..(2): Any amino acid
VXKS

SEQ ID NO: 516 - protein, 4 aa, Artificial Sequence
  Description of Artificial Sequence: Synthetic peptide
  MOD_RES (2)..(2): Any amino acid
GXTT

SEQ ID NO: 517 - protein, 4 aa, Artificial Sequence
  Description of Artificial Sequence: Synthetic peptide
  MOD_RES (2)..(2): Any amino acid
GXCW

SEQ ID NO: 518 - protein, 4 aa, Artificial Sequence
  Description of Artificial Sequence: Synthetic peptide
  MOD_RES (2)..(2): Any amino acid
VXCK

SEQ ID NO: 519 - protein, 4 aa, Artificial Sequence
  Description of Artificial Sequence: Synthetic peptide
  MOD_RES (2)..(2): Any amino acid
GXCW

SEQ ID NO: 520 - protein, 4 aa, Artificial Sequence
  Description of Artificial Sequence: Synthetic peptide
  MOD_RES (2)..(2): Any amino acid
AXKT

SEQ ID NO: 521 - protein, 4 aa, Artificial Sequence
  Description of Artificial Sequence: Synthetic peptide
  MOD_RES (2)..(2): Any amino acid
CXNG

SEQ ID NO: 522 - protein, 4 aa, Artificial Sequence
  Description of Artificial Sequence: Synthetic peptide
  MOD_RES (2)..(2): Any amino acid
SXAE

SEQ ID NO: 523 - protein, 4 aa, Artificial Sequence
  Description of Artificial Sequence: Synthetic peptide
  MOD_RES (2)..(2): Any amino acid
NXGK

SEQ ID NO: 524 - protein, 4 aa, Artificial Sequence
  Description of Artificial Sequence: Synthetic peptide
  MOD_RES (2)..(2): Any amino acid
TXKT

SEQ ID NO: 525 - protein, 4 aa, Artificial Sequence
  Description of Artificial Sequence: Synthetic peptide
  MOD_RES (2)..(2): Any amino acid
NXAC

SEQ ID NO: 526 - protein, 4 aa, Artificial Sequence
  Description of Artificial Sequence: Synthetic peptide
  MOD_RES (2)..(2): Any amino acid
TXAE

SEQ ID NO: 527 - protein, 4 aa, Artificial Sequence
  Description of Artificial Sequence: Synthetic peptide
  MOD_RES (2)..(2): Any amino acid
FXNS

SEQ ID NO: 528 - protein, 4 aa, Artificial Sequence
  Description of Artificial Sequence: Synthetic peptide
  MOD_RES (2)..(2): Any amino acid
GXTN

SEQ ID NO: 529 - protein, 4 aa, Artificial Sequence
  Description of Artificial Sequence: Synthetic peptide
  MOD_RES (2)..(2): Any amino acid
QXGK

SEQ ID NO: 530 - protein, 4 aa, Artificial Sequence
  Description of Artificial Sequence: Synthetic peptide
  MOD_RES (2)..(2): Any amino acid
GXST

SEQ ID NO: 531 - protein, 4 aa, Artificial Sequence
  Description of Artificial Sequence: Synthetic peptide
  MOD_RES (2)..(2): Any amino acid
TXAQ

SEQ ID NO: 532 - protein, 4 aa, Artificial Sequence
  Description of Artificial Sequence: Synthetic peptide
  MOD_RES (2)..(2): Any amino acid
DXEG

SEQ ID NO: 533 - protein, 4 aa, Artificial Sequence
  Description of Artificial Sequence: Synthetic peptide
  MOD_RES (2)..(2): Any amino acid
SXEE

SEQ ID NO: 534 - protein, 4 aa, Artificial Sequence
  Description of Artificial Sequence: Synthetic peptide
  MOD_RES (2)..(2): Any amino acid
SXKT

SEQ ID NO: 535 - protein, 4 aa, Artificial Sequence
  Description of Artificial Sequence: Synthetic peptide
  MOD_RES (2)..(2): Any amino acid
NXRG

SEQ ID NO: 536 - protein, 4 aa, Artificial Sequence
  Description of Artificial Sequence: Synthetic peptide
  MOD_RES (2)..(2): Any amino acid
KXDK

SEQ ID NO: 537 - protein, 4 aa, Artificial Sequence
  Description of Artificial Sequence: Synthetic peptide
  MOD_RES (2)..(2): Any amino acid
KXTG

SEQ ID NO: 538 - protein, 4 aa, Artificial Sequence
  Description of Artificial Sequence: Synthetic peptide
  MOD_RES (2)..(2): Any amino acid
SXTK

SEQ ID NO: 539 - protein, 4 aa, Artificial Sequence
  Description of Artificial Sequence: Synthetic peptide
  MOD_RES (2)..(2): Any amino acid
FXGH

SEQ ID NO: 540 - protein, 4 aa, Artificial Sequence
  Description of Artificial Sequence: Synthetic peptide
  MOD_RES (2)..(2): Any amino acid
GXTS

SEQ ID NO: 541 - protein, 4 aa, Artificial Sequence
  Description of Artificial Sequence: Synthetic peptide
  MOD_RES (2)..(2): Any amino acid
CXAG

SEQ ID NO: 542 - protein, 4 aa, Artificial Sequence
  Description of Artificial Sequence: Synthetic peptide
  MOD_RES (2)..(2): Any amino acid
GXGR

SEQ ID NO: 543 - protein, 4 aa, Artificial Sequence
  Description of Artificial Sequence: Synthetic peptide
  MOD_RES (2)..(2): Any amino acid
TXVD

SEQ ID NO: 544 - protein, 4 aa, Artificial Sequence
  Description of Artificial Sequence: Synthetic peptide
  MOD_RES (2)..(2): Any amino acid
PXWN

SEQ ID NO: 545 - protein, 4 aa, Artificial Sequence
  Description of Artificial Sequence: Synthetic peptide
  MOD_RES (2)..(2): Any amino acid
AXGL

SEQ ID NO: 546 - protein, 4 aa, Artificial Sequence
  Description of Artificial Sequence: Synthetic peptide
  MOD_RES (2)..(2): Any amino acid
SXYQ

SEQ ID NO: 547 - protein, 4 aa, Artificial Sequence
  Description of Artificial Sequence: Synthetic peptide
  MOD_RES (2)..(2): Any amino acid
RXNG

SEQ ID NO: 548 - protein, 4 aa, Artificial Sequence
  Description of Artificial Sequence: Synthetic peptide
  MOD_RES (2)..(2): Any amino acid
QXPN

SEQ ID NO: 549 - protein, 4 aa, Artificial Sequence
  Description of Artificial Sequence: Synthetic peptide
  MOD_RES (2)..(2): Any amino acid
GXLA

SEQ ID NO: 550 - protein, 4 aa, Artificial Sequence
  Description of Artificial Sequence: Synthetic peptide
  MOD_RES (2)..(2): Any amino acid
TXNR

SEQ ID NO: 551 - protein, 4 aa, Artificial Sequence
  Description of Artificial Sequence: Synthetic peptide
  MOD_RES (2)..(2): Any amino acid
TXEE

SEQ ID NO: 552 - protein, 4 aa, Artificial Sequence
  Description of Artificial Sequence: Synthetic peptide
  MOD_RES (2)..(2): Any amino acid
NXAL

SEQ ID NO: 553 - protein, 4 aa, Artificial Sequence
  Description of Artificial Sequence: Synthetic peptide
  MOD_RES (2)..(2): Any amino acid
TXTG

SEQ ID NO: 554 - protein, 4 aa, Artificial Sequence
  Description of Artificial Sequence: Synthetic peptide
  MOD_RES (2)..(2): Any amino acid
SXKS

SEQ ID NO: 555 - protein, 4 aa, Artificial Sequence
  Description of Artificial Sequence: Synthetic peptide
  MOD_RES (2)..(2): Any amino acid
WXGP

SEQ ID NO: 556 - protein, 4 aa, Artificial Sequence
  Description of Artificial Sequence: Synthetic peptide
  MOD_RES (2)..(2): Any amino acid
GXSS

SEQ ID NO: 557 - protein, 4 aa, Artificial Sequence
  Description of Artificial Sequence: Synthetic peptide
  MOD_RES (2)..(2): Any amino acid
SXAD

SEQ ID NO: 558 - protein, 4 aa, Artificial Sequence
  Description of Artificial Sequence: Synthetic peptide
  MOD_RES (2)..(2): Any amino acid
PXNV

SEQ ID NO: 559 - protein, 4 aa, Artificial Sequence
  Description of Artificial Sequence: Synthetic peptide
  MOD_RES (2)..(2): Any amino acid
QXTG

SEQ ID NO: 560 - protein, 4 aa, Artificial Sequence
  Description of Artificial Sequence: Synthetic peptide
  MOD_RES (2)..(2): Any amino acid
NXCN

SEQ ID NO: 561 - protein, 4 aa, Artificial Sequence
  Description of Artificial Sequence: Synthetic peptide
  MOD_RES (2)..(2): Any amino acid
GXGL

SEQ ID NO: 562 - protein, 4 aa, Artificial Sequence
  Description of Artificial Sequence: Synthetic peptide
  MOD_RES (2)..(2): Any amino acid
QXNT

SEQ ID NO: 563 - protein, 4 aa, Artificial Sequence
  Description of Artificial Sequence: Synthetic peptide
  MOD_RES (2)..(2): Any amino acid
GXGF

SEQ ID NO: 564 - protein, 4 aa, Artificial Sequence
  Description of Artificial Sequence: Synthetic peptide
  MOD_RES (2)..(2): Any amino acid
TXEQ

SEQ ID NO: 565 - protein, 4 aa, Artificial Sequence
  Description of Artificial Sequence: Synthetic peptide
  MOD_RES (2)..(2): Any amino acid
EXLG

SEQ ID NO: 566 - protein, 4 aa, Artificial Sequence
  Description of Artificial Sequence: Synthetic peptide
  MOD_RES (2)..(2): Any amino acid
MXIF

SEQ ID NO: 567 - protein, 4 aa, Artificial Sequence
  Description of Artificial Sequence: Synthetic peptide
  MOD_RES (2)..(2): Any amino acid
LXHA

SEQ ID NO: 568 - protein, 4 aa, Artificial Sequence
  Description of Artificial Sequence: Synthetic peptide
  MOD_RES (2)..(2): Any amino acid
MXLC

SEQ ID NO: 569 - protein, 4 aa, Artificial Sequence
  Description of Artificial Sequence: Synthetic peptide
  MOD_RES (2)..(2): Any amino acid
SXLP

SEQ ID NO: 570 - protein, 4 aa, Artificial Sequence
  Description of Artificial Sequence: Synthetic peptide
  MOD_RES (2)..(2): Any amino acid
SXKV

SEQ ID NO: 571 - protein, 4 aa, Artificial Sequence
  Description of Artificial Sequence: Synthetic peptide
  MOD_RES (2)..(2): Any amino acid
YXTM

SEQ ID NO: 572 - protein, 4 aa, Artificial Sequence
  Description of Artificial Sequence: Synthetic peptide
  MOD_RES (2)..(2): Any amino acid
DXCQ

SEQ ID NO: 573 - protein, 4 aa, Artificial Sequence
  Description of Artificial Sequence: Synthetic peptide
  MOD_RES (2)..(2): Any amino acid
LXDW

SEQ ID NO: 574 - protein, 4 aa, Artificial Sequence
  Description of Artificial Sequence: Synthetic peptide
  MOD_RES (2)..(2): Any amino acid
RXGL

SEQ ID NO: 575 - protein, 4 aa, Artificial Sequence
  Description of Artificial Sequence: Synthetic peptide
  MOD_RES (2)..(2): Any amino acid
SXEQ

SEQ ID NO: 576 - protein, 4 aa, Artificial Sequence
  Description of Artificial Sequence: Synthetic peptide
  MOD_RES (2)..(2): Any amino acid
VXKT

SEQ ID NO: 577 - protein, 4 aa, Artificial Sequence
  Description of Artificial Sequence: Synthetic peptide
  MOD_RES (2)..(2): Any amino acid
YXSG

SEQ ID NO: 578 - protein, 4 aa, Artificial Sequence
  Description of Artificial Sequence: Synthetic peptide
  MOD_RES (2)..(2): Any amino acid
NXGY

SEQ ID NO: 579 - protein, 4 aa, Artificial Sequence
  Description of Artificial Sequence: Synthetic peptide
  MOD_RES (2)..(2): Any amino acid
GXFM

SEQ ID NO: 580 - protein, 4 aa, Artificial Sequence
  Description of Artificial Sequence: Synthetic peptide
  MOD_RES (2)..(2): Any amino acid
SXMS

SEQ ID NO: 581 - protein, 4 aa, Artificial Sequence
  Description of Artificial Sequence: Synthetic peptide
  MOD_RES (2)..(2): Any amino acid
YXGD

SEQ ID NO: 582 - protein, 4 aa, Artificial Sequence
  Description of Artificial Sequence: Synthetic peptide
  MOD_RES (2)..(2): Any amino acid
NXLP

SEQ ID NO: 583 - protein, 4 aa, Artificial Sequence
  Description of Artificial Sequence: Synthetic peptide
  MOD_RES (2)..(2): Any amino acid
NXED

SEQ ID NO: 584 - protein, 4 aa, Artificial Sequence
  Description of Artificial Sequence: Synthetic peptide
  MOD_RES (2)..(2): Any amino acid
SXDE

SEQ ID NO: 585 - protein, 4 aa, Artificial Sequence
  Description of Artificial Sequence: Synthetic peptide
  MOD_RES (2)..(2): Any amino acid
YXGS

SEQ ID NO: 586 - protein, 4 aa, Artificial Sequence
  Description of Artificial Sequence: Synthetic peptide
  MOD_RES (2)..(2): Any amino acid
RXHG

SEQ ID NO: 587 - protein, 4 aa, Artificial Sequence
  Description of Artificial Sequence: Synthetic peptide
  MOD_RES (2)..(2): Any amino acid
AXGK

SEQ ID NO: 588 - protein, 4 aa, Artificial Sequence
  Description of Artificial Sequence: Synthetic peptide
  MOD_RES (2)..(2): Any amino acid
SXSE

SEQ ID NO: 589 - protein, 4 aa, Artificial Sequence
  Description of Artificial Sequence: Synthetic peptide
  MOD_RES (2)..(2): Any amino acid
DXVT

SEQ ID NO: 590 - protein, 4 aa, Artificial Sequence
  Description of Artificial Sequence: Synthetic peptide
  MOD_RES (2)..(2): Any amino acid
PXKC

SEQ ID NO: 591 - protein, 4 aa, Artificial Sequence
  Description of Artificial Sequence: Synthetic peptide
  MOD_RES (2)..(2): Any amino acid
KXLG

SEQ ID NO: 592 - protein, 4 aa, Artificial Sequence
  Description of Artificial Sequence: Synthetic peptide
  MOD_RES (2)..(2): Any amino acid
RXSE

SEQ ID NO: 593 - protein, 4 aa, Artificial Sequence
  Description of Artificial Sequence: Synthetic peptide
  MOD_RES (2)..(2): Any amino acid
TXNI

SEQ ID NO: 594 - protein, 4 aa, Artificial Sequence
  Description of Artificial Sequence: Synthetic peptide
  MOD_RES (2)..(2): Any amino acid
AXGF

SEQ ID NO: 595 - protein, 4 aa, Artificial Sequence
  Description of Artificial Sequence: Synthetic peptide
  MOD_RES (2)..(2): Any amino acid
PXSQ

SEQ ID NO: 596 - protein, 4 aa, Artificial Sequence
  Description of Artificial Sequence: Synthetic peptide
  MOD_RES (2)..(2): Any amino acid
EXLP

SEQ ID NO: 597 - protein, 4 aa, Artificial Sequence
  Description of Artificial Sequence: Synthetic peptide
  MOD_RES (2)..(2): Any amino acid
KXHG

SEQ ID NO: 598 - protein, 4 aa, Artificial Sequence
  Description of Artificial Sequence: Synthetic peptide
  MOD_RES (2)..(2): Any amino acid
GXGR

SEQ ID NO: 599 - protein, 4 aa, Artificial Sequence
  Description of Artificial Sequence: Synthetic peptide
  MOD_RES (2)..(2): Any amino acid
VXHG

SEQ ID NO: 600 - protein, 4 aa, Artificial Sequence
  Description of Artificial Sequence: Synthetic peptide
  MOD_RES (2)..(2): Any amino acid
DXAS

SEQ ID NO: 601 - protein, 4 aa, Artificial Sequence
  Description of Artificial Sequence: Synthetic peptide
  MOD_RES (2)..(2): Any amino acid
EXFG

SEQ ID NO: 602 - protein, 4 aa, Artificial Sequence
  Description of Artificial Sequence: Synthetic peptide
  MOD_RES (2)..(2): Any amino acid
EXSG

SEQ ID NO: 603 - protein, 4 aa, Artificial Sequence
  Description of Artificial Sequence: Synthetic peptide
  MOD_RES (2)..(2): Any amino acid
RXTG

SEQ ID NO: 604 - protein, 4 aa, Artificial Sequence
  Description of Artificial Sequence: Synthetic peptide
  MOD_RES (2)..(2): Any amino acid
EXTG

SEQ ID NO: 605 - protein, 4 aa, Artificial Sequence
  Description of Artificial Sequence: Synthetic peptide
  MOD_RES (2)..(2): Any amino acid
NXAQ

SEQ ID NO: 606 - protein, 4 aa, Artificial Sequence
  Description of Artificial Sequence: Synthetic peptide
  MOD_RES (2)..(2): Any amino acid
SXQE

SEQ ID NO: 607 - protein, 4 aa, Artificial Sequence
  Description of Artificial Sequence: Synthetic peptide
  MOD_RES (2)..(2): Any amino acid
CXSC

SEQ ID NO: 608 - protein, 4 aa, Artificial Sequence
  Description of Artificial Sequence: Synthetic peptide
  MOD_RES (2)..(2): Any amino acid
FXTN

SEQ ID NO: 609 - protein, 4 aa, Artificial Sequence
  Description of Artificial Sequence: Synthetic peptide
  MOD_RES (2)..(2): Any amino acid
TXNG

SEQ ID NO: 610 - protein, 4 aa, Artificial Sequence
  Description of Artificial Sequence: Synthetic peptide
  MOD_RES (2)..(2): Any amino acid
PXDQ

SEQ ID NO: 611 - protein, 4 aa, Artificial Sequence
  Description of Artificial Sequence: Synthetic peptide
  MOD_RES (2)..(2): Any amino acid
QXVI

SEQ ID NO: 612 - protein, 4 aa, Artificial Sequence
  Description of Artificial Sequence: Synthetic peptide
  MOD_RES (2)..(2): Any amino acid
EXGG

SEQ ID NO: 613 - protein, 4 aa, Artificial Sequence
  Description of Artificial Sequence: Synthetic peptide
  MOD_RES (3)..(3): Any amino acid
GKXT

SEQ ID NO: 614 - protein, 4 aa, Artificial Sequence
  Description of Artificial Sequence: Synthetic peptide
  MOD_RES (3)..(3): Any amino acid
GKXS

SEQ ID NO: 615 - protein, 4 aa, Artificial Sequence
  Description of Artificial Sequence: Synthetic peptide
  MOD_RES (3)..(3): Any amino acid
TGXT

SEQ ID NO: 616 - protein, 4 aa, Artificial Sequence
  Description of Artificial Sequence: Synthetic peptide
  MOD_RES (3)..(3): Any amino acid
VGXS

SEQ ID NO: 617 - protein, 4 aa, Artificial Sequence
  Description of Artificial Sequence: Synthetic peptide
  MOD_RES (3)..(3): Any amino acid
NKXD

SEQ ID NO: 618 - protein, 4 aa, Artificial Sequence
  Description of Artificial Sequence: Synthetic peptide
  MOD_RES (3)..(3): Any amino acid
GSXK

SEQ ID NO: 619 - protein, 4 aa, Artificial Sequence
  Description of Artificial Sequence: Synthetic peptide
  MOD_RES (3)..(3): Any amino acid
GVXK

SEQ ID NO: 620 - protein, 4 aa, Artificial Sequence
  Description of Artificial Sequence: Synthetic peptide
  MOD_RES (3)..(3): Any amino acid
CKXG

SEQ ID NO: 621 - protein, 4 aa, Artificial Sequence
  Description of Artificial Sequence: Synthetic peptide
  MOD_RES (3)..(3): Any amino acid
GTXK

SEQ ID NO: 622 - protein, 4 aa, Artificial Sequence
  Description of Artificial Sequence: Synthetic peptide
  MOD_RES (3)..(3): Any amino acid
GFXN

SEQ ID NO: 623 - protein, 4 aa, Artificial Sequence
  Description of Artificial Sequence: Synthetic peptide
  MOD_RES (3)..(3): Any amino acid
WCXP

SEQ ID NO: 624 - protein, 4 aa, Artificial Sequence
  Description of Artificial Sequence: Synthetic peptide
  MOD_RES (3)..(3): Any amino acid
FTXS

SEQ ID NO: 625 - protein, 4 aa, Artificial Sequence
  Description of Artificial Sequence: Synthetic peptide
  MOD_RES (3)..(3): Any amino acid
NVXC

SEQ ID NO: 626 - protein, 4 aa, Artificial Sequence
  Description of Artificial Sequence: Synthetic peptide
  MOD_RES (3)..(3): Any amino acid
VAXK

SEQ ID NO: 627 - protein, 4 aa, Artificial Sequence
  Description of Artificial Sequence: Synthetic peptide
  MOD_RES (3)..(3): Any amino acid
SGXT

SEQ ID NO: 628 - protein, 4 aa, Artificial Sequence
  Description of Artificial Sequence: Synthetic peptide
  MOD_RES (3)..(3): Any amino acid
AGXT

SEQ ID NO: 629 - protein, 4 aa, Artificial Sequence
  Description of Artificial Sequence: Synthetic peptide
  MOD_RES (3)..(3): Any amino acid
GGXM

SEQ ID NO: 630 - protein, 4 aa, Artificial Sequence
  Description of Artificial Sequence: Synthetic peptide
  MOD_RES (3)..(3): Any amino acid
SGXS

SEQ ID NO: 631 - protein, 4 aa, Artificial Sequence
  Description of Artificial Sequence: Synthetic peptide
  MOD_RES (3)..(3): Any amino acid
ERXG

SEQ ID NO: 632 - protein, 4 aa, Artificial Sequence
  Description of Artificial Sequence: Synthetic peptide
  MOD_RES (3)..(3): Any amino acid
DSXE

SEQ ID NO: 633 - protein, 4 aa, Artificial Sequence
  Description of Artificial Sequence: Synthetic peptide
  MOD_RES (3)..(3): Any amino acid
REXG

SEQ ID NO: 634 - protein, 4 aa, Artificial Sequence
  Description of Artificial Sequence: Synthetic peptide
  MOD_RES (3)..(3): Any amino acid
DSXT

SEQ ID NO: 635 - protein, 4 aa, Artificial Sequence
  Description of Artificial Sequence: Synthetic peptide
  MOD_RES (3)..(3): Any amino acid
QFXT

SEQ ID NO: 636 - protein, 4 aa, Artificial Sequence
  Description of Artificial Sequence: Synthetic peptide
  MOD_RES (3)..(3): Any amino acid
GAXK

SEQ ID NO: 637 - protein, 4 aa, Artificial Sequence
  Description of Artificial Sequence: Synthetic peptide
  MOD_RES (3)..(3): Any amino acid
VGXT

SEQ ID NO: 638 - protein, 4 aa, Artificial Sequence
  Description of Artificial Sequence: Synthetic peptide
  MOD_RES (3)..(3): Any amino acid
NQXP

SEQ ID NO: 639 - protein, 4 aa, Artificial Sequence
  Description of Artificial Sequence: Synthetic peptide
  MOD_RES (3)..(3): Any amino acid
TKXD

SEQ ID NO: 640 - protein, 4 aa, Artificial Sequence
  Description of Artificial Sequence: Synthetic peptide
  MOD_RES (3)..(3): Any amino acid
QAXG

SEQ ID NO: 641 - protein, 4 aa, Artificial Sequence
  Description of Artificial Sequence: Synthetic peptide
  MOD_RES (3)..(3): Any amino acid
KVXK

SEQ ID NO: 642 - protein, 4 aa, Artificial Sequence
  Description of Artificial Sequence: Synthetic peptide
  MOD_RES (3)..(3): Any amino acid
IDXS

SEQ ID NO: 643 - protein, 4 aa, Artificial Sequence
  Description of Artificial Sequence: Synthetic peptide
  MOD_RES (3)..(3): Any amino acid
STXV

SEQ ID NO: 644 - protein, 4 aa, Artificial Sequence
  Description of Artificial Sequence: Synthetic peptide
  MOD_RES (3)..(3): Any amino acid
FYXM

SEQ ID NO: 645 - protein, 4 aa, Artificial Sequence
  Description of Artificial Sequence: Synthetic peptide
  MOD_RES (3)..(3): Any amino acid
NIXM

SEQ ID NO: 646 - protein, 4 aa, Artificial Sequence
  Description of Artificial Sequence: Synthetic peptide
  MOD_RES (3)..(3): Any amino acid
PTXN

SEQ ID NO: 647 - protein, 4 aa, Artificial Sequence
  Description of Artificial Sequence: Synthetic peptide
  MOD_RES (3)..(3): Any amino acid
NKXG

SEQ ID NO: 648 - protein, 4 aa, Artificial Sequence
  Description of Artificial Sequence: Synthetic peptide
  MOD_RES (3)..(3): Any amino acid
NKXD

SEQ ID NO: 649 - protein, 4 aa, Artificial Sequence
  Description of Artificial Sequence: Synthetic peptide
  MOD_RES (3)..(3): Any amino acid
YAXG

SEQ ID NO: 650 - protein, 4 aa, Artificial Sequence
  Description of Artificial Sequence: Synthetic peptide
  MOD_RES (3)..(3): Any amino acid
YSXM

SEQ ID NO: 651 - protein, 4 aa, Artificial Sequence
  Description of Artificial Sequence: Synthetic peptide
  MOD_RES (3)..(3): Any amino acid
ACXN

SEQ ID NO: 652 - protein, 4 aa, Artificial Sequence
  Description of Artificial Sequence: Synthetic peptide
  MOD_RES (3)..(3): Any amino acid
RRXG

SEQ ID NO: 653 - protein, 4 aa, Artificial Sequence
  Description of Artificial Sequence: Synthetic peptide
  MOD_RES (3)..(3): Any amino acid
FPXH

SEQ ID NO: 654 - protein, 4 aa, Artificial Sequence
  Description of Artificial Sequence: Synthetic peptide
  MOD_RES (3)..(3): Any amino acid
VSXG

SEQ ID NO: 655 - protein, 4 aa, Artificial Sequence
  Description of Artificial Sequence: Synthetic peptide
  MOD_RES (3)..(3): Any amino acid
RAXG

SEQ ID NO: 656 - protein, 4 aa, Artificial Sequence
  Description of Artificial Sequence: Synthetic peptide
  MOD_RES (3)..(3): Any amino acid
KDXG

SEQ ID NO: 657 - protein, 4 aa, Artificial Sequence
  Description of Artificial Sequence: Synthetic peptide
  MOD_RES (3)..(3): Any amino acid
SSXK

SEQ ID NO: 658 - protein, 4 aa, Artificial Sequence
  Description of Artificial Sequence: Synthetic peptide
  MOD_RES (3)..(3): Any amino acid
RRXG

SEQ ID NO: 659 - protein, 4 aa, Artificial Sequence
  Description of Artificial Sequence: Synthetic peptide
  MOD_RES (3)..(3): Any amino acid
KKXG

SEQ ID NO: 660 - protein, 4 aa, Artificial Sequence
  Description of Artificial Sequence: Synthetic peptide
  MOD_RES (3)..(3): Any amino acid
GSXW

SEQ ID NO: 661 - protein, 4 aa, Artificial Sequence
  Description of Artificial Sequence: Synthetic peptide
  MOD_RES (3)..(3): Any amino acid
GLXP

SEQ ID NO: 662 - protein, 4 aa, Artificial Sequence
  Description of Artificial Sequence: Synthetic peptide
  MOD_RES (3)..(3): Any amino acid
KGXG

SEQ ID NO: 663 - protein, 4 aa, Artificial Sequence
  Description of Artificial Sequence: Synthetic peptide
  MOD_RES (3)..(3): Any amino acid
KQXT

SEQ ID NO: 664 - protein, 4 aa, Artificial Sequence
  Description of Artificial Sequence: Synthetic peptide
  MOD_RES (3)..(3): Any amino acid
ARXP

SEQ ID NO: 665 - protein, 4 aa, Artificial Sequence
  Description of Artificial Sequence: Synthetic peptide
  MOD_RES (3)..(3): Any amino acid
ETXS

SEQ ID NO: 666 - protein, 4 aa, Artificial Sequence
  Description of Artificial Sequence: Synthetic peptide
  MOD_RES (3)..(3): Any amino acid
DKXG

SEQ ID NO: 667 - protein, 4 aa, Artificial Sequence
  Description of Artificial Sequence: Synthetic peptide
  MOD_RES (3)..(3): Any amino acid
KPXY

SEQ ID NO: 668 - protein, 4 aa, Artificial Sequence
  Description of Artificial Sequence: Synthetic peptide
  MOD_RES (3)..(3): Any amino acid
QTXK

SEQ ID NO: 669 - protein, 4 aa, Artificial Sequence
  Description of Artificial Sequence: Synthetic peptide
  MOD_RES (3)..(3): Any amino acid
RSXG

SEQ ID NO: 670 - protein, 4 aa, Artificial Sequence
  Description of Artificial Sequence: Synthetic peptide
  MOD_RES (3)..(3): Any amino acid
KMXF

SEQ ID NO: 671 - protein, 4 aa, Artificial Sequence
  Description of Artificial Sequence: Synthetic peptide
  MOD_RES (3)..(3): Any amino acid
RKXG

SEQ ID NO: 672 - protein, 4 aa, Artificial Sequence
  Description of Artificial Sequence: Synthetic peptide
  MOD_RES (3)..(3): Any amino acid
EEXG

SEQ ID NO: 673 - protein, 4 aa, Artificial Sequence
  Description of Artificial Sequence: Synthetic peptide
  MOD_RES (3)..(3): Any amino acid
AAXG

SEQ ID NO: 674 - protein, 4 aa, Artificial Sequence
  Description of Artificial Sequence: Synthetic peptide
  MOD_RES (3)..(3): Any amino acid
LSXE

SEQ ID NO: 675 - protein, 4 aa, Artificial Sequence
  Description of Artificial Sequence: Synthetic peptide
  MOD_RES (3)..(3): Any amino acid
KAXG

SEQ ID NO: 676 - protein, 4 aa, Artificial Sequence
  Description of Artificial Sequence: Synthetic peptide
  MOD_RES (3)..(3): Any amino acid
MNXF

SEQ ID NO: 677 - protein, 4 aa, Artificial Sequence
  Description of Artificial Sequence: Synthetic peptide
  MOD_RES (3)..(3): Any amino acid
LTXW

SEQ ID NO: 678 - protein, 4 aa, Artificial Sequence
  Description of Artificial Sequence: Synthetic peptide
  MOD_RES (3)..(3): Any amino acid
NPXE

SEQ ID NO: 679 - protein, 4 aa, Artificial Sequence
  Description of Artificial Sequence: Synthetic peptide
  MOD_RES (3)..(3): Any amino acid
WLXV

SEQ ID NO: 680 - protein, 4 aa, Artificial Sequence
  Description of Artificial Sequence: Synthetic peptide
  MOD_RES (3)..(3): Any amino acid
GVXF

SEQ ID NO: 681 - protein, 4 aa, Artificial Sequence
  Description of Artificial Sequence: Synthetic peptide
  MOD_RES (3)..(3): Any amino acid
SAXG

SEQ ID NO: 682 - protein, 4 aa, Artificial Sequence
  Description of Artificial Sequence: Synthetic peptide
  MOD_RES (3)..(3): Any amino acid
CGXC

SEQ ID NO: 683 - protein, 4 aa, Artificial Sequence
  Description of Artificial Sequence: Synthetic peptide
  MOD_RES (3)..(3): Any amino acid
GSXW

SEQ ID NO: 684 - protein, 4 aa, Artificial Sequence
  Description of Artificial Sequence: Synthetic peptide
  MOD_RES (3)..(3): Any amino acid
KNXA

SEQ ID NO: 685 - protein, 4 aa, Artificial Sequence
  Description of Artificial Sequence: Synthetic peptide
  MOD_RES (3)..(3): Any amino acid
EAXG

SEQ ID NO: 686 - protein, 4 aa, Artificial Sequence
  Description of Artificial Sequence: Synthetic peptide
  MOD_RES (3)..(3): Any amino acid
GKXA

SEQ ID NO: 687 - protein, 4 aa, Artificial Sequence
  Description of Artificial Sequence: Synthetic peptide
  MOD_RES (3)..(3): Any amino acid
QKXG

SEQ ID NO: 688 - protein, 4 aa, Artificial Sequence
  Description of Artificial Sequence: Synthetic peptide
  MOD_RES (3)..(3): Any amino acid
FMXQ

SEQ ID NO: 689 - protein, 4 aa, Artificial Sequence
  Description of Artificial Sequence: Synthetic peptide
  MOD_RES (3)..(3): Any amino acid
LAXG

SEQ ID NO: 690 - protein, 4 aa, Artificial Sequence
  Description of Artificial Sequence: Synthetic peptide
  MOD_RES (3)..(3): Any amino acid
FNXN

SEQ ID NO: 691 - protein, 4 aa, Artificial Sequence
  Description of Artificial Sequence: Synthetic peptide
  MOD_RES (3)..(3): Any amino acid
TQXG

SEQ ID NO: 692 - protein, 4 aa, Artificial Sequence
  Description of Artificial Sequence: Synthetic peptide
  MOD_RES (3)..(3): Any amino acid
TWXI

SEQ ID NO: 693 - protein, 4 aa, Artificial Sequence
  Description of Artificial Sequence: Synthetic peptide
  MOD_RES (3)..(3): Any amino acid
WGXG

SEQ ID NO: 694 - protein, 4 aa, Artificial Sequence
  Description of Artificial Sequence: Synthetic peptide
  MOD_RES (3)..(3): Any amino acid
DRXG

SEQ ID NO: 695 - protein, 4 aa, Artificial Sequence
  Description of Artificial Sequence: Synthetic peptide
  MOD_RES (3)..(3): Any amino acid
GDXT

SEQ ID NO: 696 - protein, 4 aa, Artificial Sequence
  Description of Artificial Sequence: Synthetic peptide
  MOD_RES (3)..(3): Any amino acid
PFXA

SEQ ID NO: 697 - protein, 4 aa, Artificial Sequence
  Description of Artificial Sequence: Synthetic peptide
  MOD_RES (3)..(3): Any amino acid
DHXK

SEQ ID NO: 698 - protein, 4 aa, Artificial Sequence
  Description of Artificial Sequence: Synthetic peptide
  MOD_RES (3)..(3): Any amino acid
ISXE

SEQ ID NO: 699 - protein, 4 aa, Artificial Sequence
  Description of Artificial Sequence: Synthetic peptide
  MOD_RES (3)..(3): Any amino acid
RMXT

SEQ ID NO: 700 - protein, 4 aa, Artificial Sequence
  Description of Artificial Sequence: Synthetic peptide
  MOD_RES (3)..(3): Any amino acid
ANXP

SEQ ID NO: 701 - protein, 4 aa, Artificial Sequence
  Description of Artificial Sequence: Synthetic peptide
  MOD_RES (3)..(3): Any amino acid
LSXG

SEQ ID NO: 702 - protein, 4 aa, Artificial Sequence
  Description of Artificial Sequence: Synthetic peptide
  MOD_RES (3)..(3): Any amino acid
GLXR

SEQ ID NO: 703 - protein, 4 aa, Artificial Sequence
  Description of Artificial Sequence: Synthetic peptide
  MOD_RES (3)..(3): Any amino acid
YWXD

SEQ ID NO: 704 - protein, 4 aa, Artificial Sequence
  Description of Artificial Sequence: Synthetic peptide
  MOD_RES (3)..(3): Any amino acid
DAXG

SEQ ID NO: 705 - protein, 4 aa, Artificial Sequence
  Description of Artificial Sequence: Synthetic peptide
  MOD_RES (3)..(3): Any amino acid
QGXG

SEQ ID NO: 706 - protein, 4 aa, Artificial Sequence
  Description of Artificial Sequence: Synthetic peptide
  MOD_RES (3)..(3): Any amino acid
EGXT

SEQ ID NO: 707 - protein, 4 aa, Artificial Sequence
  Description of Artificial Sequence: Synthetic peptide
  MOD_RES (3)..(3): Any amino acid
SGXW

SEQ ID NO: 708 - protein, 4 aa, Artificial Sequence
  Description of Artificial Sequence: Synthetic peptide
  MOD_RES (3)..(3): Any amino acid
KEXG

SEQ ID NO: 709 - protein, 4 aa, Artificial Sequence
  Description of Artificial Sequence: Synthetic peptide
  MOD_RES (3)..(3): Any amino acid
QEXG

SEQ ID NO: 710 - protein, 4 aa, Artificial Sequence
  Description of Artificial Sequence: Synthetic peptide
  MOD_RES (3)..(3): Any amino acid
KSXW

SEQ ID NO: 711 - protein, 4 aa, Artificial Sequence
  Description of Artificial Sequence: Synthetic peptide
  MOD_RES (3)..(3): Any amino acid
CGXC

SEQ ID NO: 712 - protein, 4 aa, Artificial Sequence
  Description of Artificial Sequence: Synthetic peptide
GKTT

SEQ ID NO: 713 - protein, 4 aa, Artificial Sequence
  Description of Artificial Sequence: Synthetic peptide
GKST

SEQ ID NO: 714 - protein, 4 aa, Artificial Sequence
  Description of Artificial Sequence: Synthetic peptide
VGKS

SEQ ID NO: 715 - protein, 4 aa, Artificial Sequence
  Description of Artificial Sequence: Synthetic peptide
AGKT

SEQ ID NO: 716 - protein, 4 aa, Artificial Sequence
  Description of Artificial Sequence: Synthetic peptide
GVGK

SEQ ID NO: 717 - protein, 4 aa, Artificial Sequence
  Description of Artificial Sequence: Synthetic peptide
GSGK

SEQ ID NO: 718 - protein, 4 aa, Artificial Sequence
  Description of Artificial Sequence: Synthetic peptide
TGKT

SEQ ID NO: 719 - protein, 4 aa, Artificial Sequence
  Description of Artificial Sequence: Synthetic peptide
VACK

SEQ ID NO: 720 - protein, 4 aa, Artificial Sequence
  Description of Artificial Sequence: Synthetic peptide
CSAG

SEQ ID NO: 721 - protein, 4 aa, Artificial Sequence
  Description of Artificial Sequence: Synthetic peptide
KVDK

SEQ ID NO: 722 - protein, 4 aa, Artificial Sequence
  Description of Artificial Sequence: Synthetic peptide
TKVD

SEQ ID NO: 723 - protein, 4 aa, Artificial Sequence
  Description of Artificial Sequence: Synthetic peptide
GAGK

SEQ ID NO: 724 - protein, 4 aa, Artificial Sequence
  Description of Artificial Sequence: Synthetic peptide
CKNG

SEQ ID NO: 725 - protein, 4 aa, Artificial Sequence
  Description of Artificial Sequence: Synthetic peptide
STKV

SEQ ID NO: 726 - protein, 4 aa, Artificial Sequence
  Description of Artificial Sequence: Synthetic peptide
GSCW

SEQ ID NO: 727 - protein, 4 aa, Artificial Sequence
  Description of Artificial Sequence: Synthetic peptide
NVAC

SEQ ID NO: 728 - protein, 4 aa, Artificial Sequence
  Description of Artificial Sequence: Synthetic peptide
GKTS

SEQ ID NO: 729 - protein, 4 aa, Artificial Sequence
  Description of Artificial Sequence: Synthetic peptide
SGKT

SEQ ID NO: 730 - protein, 4 aa, Artificial Sequence
  Description of Artificial Sequence: Synthetic peptide
GTGK

SEQ ID NO: 731 - protein, 4 aa, Artificial Sequence
  Description of Artificial Sequence: Synthetic peptide
FTNS

SEQ ID NO: 732 - protein, 4 aa, Artificial Sequence
  Description of Artificial Sequence: Synthetic peptide
GSCW

SEQ ID NO: 733 - protein, 4 aa, Artificial Sequence
  Description of Artificial Sequence: Synthetic peptide
SGKS

SEQ ID NO: 734 - protein, 4 aa, Artificial Sequence
  Description of Artificial Sequence: Synthetic peptide
VGKT

SEQ ID NO: 735 - protein, 4 aa, Artificial Sequence
  Description of Artificial Sequence: Synthetic peptide
DKEG

SEQ ID NO: 736 - protein, 4 aa, Artificial Sequence
  Description of Artificial Sequence: Synthetic peptide
FPGH

SEQ ID NO: 737 - protein, 4 aa, Artificial Sequence
  Description of Artificial Sequence: Synthetic peptide
WCGP

SEQ ID NO: 738 - protein, 4 aa, Artificial Sequence
  Description of Artificial Sequence: Synthetic peptide
GFTN

SEQ ID NO: 739 - protein, 4 aa, Artificial Sequence
  Description of Artificial Sequence: Synthetic peptide
LTDW

SEQ ID NO: 740 - protein, 4 aa, Artificial Sequence
  Description of Artificial Sequence: Synthetic peptide
PGPP

SEQ ID NO: 741 - protein, 4 aa, Artificial Sequence
  Description of Artificial Sequence: Synthetic peptide
QFNT

SEQ ID NO: 742 - protein, 4 aa, Artificial Sequence
  Description of Artificial Sequence: Synthetic peptide
TQTG

SEQ ID NO: 743 - protein, 4 aa, Artificial Sequence
  Description of Artificial Sequence: Synthetic peptide
LNHA

SEQ ID NO: 744 - protein, 4 aa, Artificial Sequence
  Description of Artificial Sequence: Synthetic peptide
GKSS

SEQ ID NO: 745 - protein, 4 aa, Artificial Sequence
  Description of Artificial Sequence: Synthetic peptide
QHFK

SEQ ID NO: 746 - protein, 4 aa, Artificial Sequence
  Description of Artificial Sequence: Synthetic peptide
SSTK

SEQ ID NO: 747 - protein, 4 aa, Artificial Sequence
  Description of Artificial Sequence: Synthetic peptide
RWNR

SEQ ID NO: 748 - protein, 4 aa, Artificial Sequence
  Description of Artificial Sequence: Synthetic peptide
NVGK

SEQ ID NO: 749 - protein, 4 aa, Artificial Sequence
  Description of Artificial Sequence: Synthetic peptide
ACKN

SEQ ID NO: 750 - protein, 4 aa, Artificial Sequence
  Description of Artificial Sequence: Synthetic peptide
NAGK

SEQ ID NO: 751 - protein, 4 aa, Artificial Sequence
  Description of Artificial Sequence: Synthetic peptide
HTFI

SEQ ID NO: 752 - protein, 4 aa, Artificial Sequence
  Description of Artificial Sequence: Synthetic peptide
EAHV

SEQ ID NO: 753 - protein, 4 aa, Artificial Sequence
  Description of Artificial Sequence: Synthetic peptide
FADK

SEQ ID NO: 754 - protein, 4 aa, Artificial Sequence
  Description of Artificial Sequence: Synthetic peptide
FHIS

SEQ ID NO: 755 - protein, 4 aa, Artificial Sequence
  Description of Artificial Sequence: Synthetic peptide
ADKL

SEQ ID NO: 756 - protein, 4 aa, Artificial Sequence
  Description of Artificial Sequence: Synthetic peptide
AGKS

SEQ ID NO: 757 - protein, 4 aa, Artificial Sequence
  Description of Artificial Sequence: Synthetic peptide
TFGK

SEQ ID NO: 758 - protein, 4 aa, Artificial Sequence
  Description of Artificial Sequence: Synthetic peptide
ANHI

SEQ ID NO: 759 - protein, 4 aa, Artificial Sequence
  Description of Artificial Sequence: Synthetic peptide
YIKI

SEQ ID NO: 760 - protein, 4 aa, Artificial Sequence
  Description of Artificial Sequence: Synthetic peptide
AGMD

SEQ ID NO: 761 - protein, 4 aa, Artificial Sequence
  Description of Artificial Sequence: Synthetic peptide
LFLE

SEQ ID NO: 762 - protein, 4 aa, Artificial Sequence
  Description of Artificial Sequence: Synthetic peptide
VATS

SEQ ID NO: 763 - protein, 4 aa, Artificial Sequence
  Description of Artificial Sequence: Synthetic peptide
GLGF

SEQ ID NO: 764 - protein, 4 aa, Artificial Sequence
  Description of Artificial Sequence: Synthetic peptide
QEVI

SEQ ID NO: 765 - protein, 4 aa, Artificial Sequence
  Description of Artificial Sequence: Synthetic peptide
MELC

SEQ ID NO: 766 - protein, 4 aa, Artificial Sequence
  Description of Artificial Sequence: Synthetic peptide
MDSS

SEQ ID NO: 767 - protein, 4 aa, Artificial Sequence
  Description of Artificial Sequence: Synthetic peptide
QTGK

SEQ ID NO: 768 - protein, 4 aa, Artificial Sequence
  Description of Artificial Sequence: Synthetic peptide
PSVY

SEQ ID NO: 769 - protein, 4 aa, Artificial Sequence
  Description of Artificial Sequence: Synthetic peptide
TPNR

SEQ ID NO: 770 - protein, 4 aa, Artificial Sequence
  Description of Artificial Sequence: Synthetic peptide
KPLY

SEQ ID NO: 771 - protein, 4 aa, Artificial Sequence
  Description of Artificial Sequence: Synthetic peptide
GNLA

SEQ ID NO: 772 - protein, 4 aa, Artificial Sequence
  Description of Artificial Sequence: Synthetic peptide
AAGK

SEQ ID NO: 773 - protein, 4 aa, Artificial Sequence
  Description of Artificial Sequence: Synthetic peptide
YSTM

SEQ ID NO: 774 - protein, 4 aa, Artificial Sequence
  Description of Artificial Sequence: Synthetic peptide
MNIF

SEQ ID NO: 775 - protein, 4 aa, Artificial Sequence
  Description of Artificial Sequence: Synthetic peptide
TGNT

SEQ ID NO: 776 - protein, 4 aa, Artificial Sequence
  Description of Artificial Sequence: Synthetic peptide
NICR

SEQ ID NO: 777 - protein, 4 aa, Artificial Sequence
  Description of Artificial Sequence: Synthetic peptide
QDKE

SEQ ID NO: 778 - protein, 4 aa, Artificial Sequence
  Description of Artificial Sequence: Synthetic peptide
FNTN

SEQ ID NO: 779 - protein, 4 aa, Artificial Sequence
  Description of Artificial Sequence: Synthetic peptide
SGRT

SEQ ID NO: 780 - protein, 4 aa, Artificial Sequence
  Description of Artificial Sequence: Synthetic peptide
YRDV

SEQ ID NO: 781 - protein, 4 aa, Artificial Sequence
  Description of Artificial Sequence: Synthetic peptide
VNHG

SEQ ID NO: 782 - protein, 4 aa, Artificial Sequence
  Description of Artificial Sequence: Synthetic peptide
VDKK

SEQ ID NO: 783 - protein, 4 aa, Artificial Sequence
  Description of Artificial Sequence: Synthetic peptide
GKSA

SEQ ID NO: 784 - protein, 4 aa, Artificial Sequence
  Description of Artificial Sequence: Synthetic peptide
GLTD

SEQ ID NO: 785 - protein, 4 aa, Artificial Sequence
  Description of Artificial Sequence: Synthetic peptide
FTVA

SEQ ID NO: 786 - protein, 4 aa, Artificial Sequence
  Description of Artificial Sequence: Synthetic peptide
GGFM

SEQ ID NO: 787 - protein, 4 aa, Artificial Sequence
  Description of Artificial Sequence: Synthetic peptide
PPGP

SEQ ID NO: 788 - protein, 4 aa, Artificial Sequence
  Description of Artificial Sequence: Synthetic peptide
PTWN

SEQ ID NO: 789 - protein, 4 aa, Artificial Sequence
  Description of Artificial Sequence: Synthetic peptide
STMS

SEQ ID NO: 790 - protein, 4 aa, Artificial Sequence
  Description of Artificial Sequence: Synthetic peptide
GVCS

SEQ ID NO: 791 - protein, 4 aa, Artificial Sequence
  Description of Artificial Sequence: Synthetic peptide
YASG

SEQ ID NO: 792 - protein, 4 aa, Artificial Sequence
  Description of Artificial Sequence: Synthetic peptide
GGLM

SEQ ID NO: 793 - protein, 4 aa, Artificial Sequence
  Description of Artificial Sequence: Synthetic peptide
DACQ

SEQ ID NO: 794 - protein, 4 aa, Artificial Sequence
  Description of Artificial Sequence: Synthetic peptide
GLGR

SEQ ID NO: 795 - protein, 4 aa, Artificial Sequence
  Description of Artificial Sequence: Synthetic peptide
VSWG

SEQ ID NO: 796 - protein, 4 aa, Artificial Sequence
  Description of Artificial Sequence: Synthetic peptide
DSVT

SEQ ID NO: 797 - protein, 4 aa, Artificial Sequence
  Description of Artificial Sequence: Synthetic peptide
GIMS

SEQ ID NO: 798 - protein, 4 aa, Artificial Sequence
  Description of Artificial Sequence: Synthetic peptide
SGVG

SEQ ID NO: 799 - protein, 4 aa, Artificial Sequence
  Description of Artificial Sequence: Synthetic peptide
WNIG

SEQ ID NO: 800 - protein, 4 aa, Artificial Sequence
  Description of Artificial Sequence: Synthetic peptide
DSCQ

SEQ ID NO: 801 - protein, 4 aa, Artificial Sequence
  Description of Artificial Sequence: Synthetic peptide
QTPN

SEQ ID NO: 802 - protein, 4 aa, Artificial Sequence
  Description of Artificial Sequence: Synthetic peptide
KSRW

SEQ ID NO: 803 - protein, 4 aa, Artificial Sequence
  Description of Artificial Sequence: Synthetic peptide
STVE

SEQ ID NO: 804 - protein, 4 aa, Artificial Sequence
  Description of Artificial Sequence: Synthetic peptide
ACNG

SEQ ID NO: 805 - protein, 4 aa, Artificial Sequence
  Description of Artificial Sequence: Synthetic peptide
GACW

SEQ ID NO: 806 - protein, 4 aa, Artificial Sequence
  Description of Artificial Sequence: Synthetic peptide
GVGR

SEQ ID NO: 807 - protein, 4 aa, Artificial Sequence
  Description of Artificial Sequence: Synthetic peptide
AGIG

SEQ ID NO: 808 - protein, 4 aa, Artificial Sequence
  Description of Artificial Sequence: Synthetic peptide
HGKT

SEQ ID NO: 809 - protein, 4 aa, Artificial Sequence
  Description of Artificial Sequence: Synthetic peptide
TLIS

SEQ ID NO: 810 - protein, 4 aa, Artificial Sequence
  Description of Artificial Sequence: Synthetic peptide
NTKV

SEQ ID NO: 811 - protein, 5 aa, Artificial Sequence
  Description of Artificial Sequence: Synthetic peptide
  MOD_RES (2)..(4): Any amino acid
EXXXR

SEQ ID NO: 812 - protein, 5 aa, Artificial Sequence
  Description of Artificial Sequence: Synthetic peptide
  MOD_RES (2)..(4): Any amino acid
RXXXE

SEQ ID NO: 813 - protein, 5 aa, Artificial Sequence
  Description of Artificial Sequence: Synthetic peptide
  MOD_RES (2)..(4): Any amino acid
QXXXD

SEQ ID NO: 814 - protein, 5 aa, Artificial Sequence
  Description of Artificial Sequence: Synthetic peptide
  MOD_RES (2)..(4): Any amino acid
RXXXR

SEQ ID NO: 815 - protein, 5 aa, Artificial Sequence
  Description of Artificial Sequence: Synthetic peptide
  MOD_RES (2)..(4): Any amino acid
EXXXE

SEQ ID NO: 816 - protein, 5 aa, Artificial Sequence
  Description of Artificial Sequence: Synthetic peptide
  MOD_RES (2)..(4): Any amino acid
DXXXR

SEQ ID NO: 817 - protein, 5 aa, Artificial Sequence
  Description of Artificial Sequence: Synthetic peptide
  MOD_RES (2)..(4): Any amino acid
EXXXQ

SEQ ID NO: 818 - protein, 5 aa, Artificial Sequence
  Description of Artificial Sequence: Synthetic peptide
  MOD_RES (2)..(4): Any amino acid
AXXXR

SEQ ID NO: 819 - protein, 5 aa, Artificial Sequence
  Description of Artificial Sequence: Synthetic peptide
  MOD_RES (2)..(4): Any amino acid
QXXXR

SEQ ID NO: 820 - protein, 5 aa, Artificial Sequence
  Description of Artificial Sequence: Synthetic peptide
  MOD_RES (2)..(4): Any amino acid
AXXXA

SEQ ID NO: 821 - protein, 5 aa, Artificial Sequence
  Description of Artificial Sequence: Synthetic peptide
  MOD_RES (2)..(4): Any amino acid
QXXXQ

SEQ ID NO: 822 - protein, 5 aa, Artificial Sequence
  Description of Artificial Sequence: Synthetic peptide
  MOD_RES (2)..(4): Any amino acid
QXXXE

SEQ ID NO: 823 - protein, 5 aa, Artificial Sequence
  Description of Artificial Sequence: Synthetic peptide
  MOD_RES (2)..(4): Any amino acid
EXXXA

SEQ ID NO: 824 - protein, 5 aa, Artificial Sequence
  Description of Artificial Sequence: Synthetic peptide
  MOD_RES (2)..(4): Any amino acid
AXXXQ

SEQ ID NO: 825 - protein, 5 aa, Artificial Sequence
  Description of Artificial Sequence: Synthetic peptide
  MOD_RES (2)..(4): Any amino acid
RXXXQ

SEQ ID NO: 826 - protein, 5 aa, Artificial Sequence
  Description of Artificial Sequence: Synthetic peptide
  MOD_RES (2)..(4): Any amino acid
EXXXK

SEQ ID NO: 827 - protein, 5 aa, Artificial Sequence
  Description of Artificial Sequence: Synthetic peptide
  MOD_RES (2)..(4): Any amino acid
EXXXL

SEQ ID NO: 828 - protein, 5 aa, Artificial Sequence
  Description of Artificial Sequence: Synthetic peptide
  MOD_RES (2)..(4): Any amino acid
QXXXN

SEQ ID NO: 829 - protein, 5 aa, Artificial Sequence
  Description of Artificial Sequence: Synthetic peptide
  MOD_RES (2)..(4): Any amino acid
KXXXE

SEQ ID NO: 830 - protein, 5 aa, Artificial Sequence
  Description of Artificial Sequence: Synthetic peptide
  MOD_RES (2)..(4): Any amino acid
RXXXL

SEQ ID NO: 831 - protein, 5 aa, Artificial Sequence
  Description of Artificial Sequence: Synthetic peptide
  MOD_RES (2)..(4): Any amino acid
LXXXR

SEQ ID NO: 832 - protein, 5 aa, Artificial Sequence
  Description of Artificial Sequence: Synthetic peptide
  MOD_RES (2)..(4): Any amino acid
LXXXE

SEQ ID NO: 833 - protein, 5 aa, Artificial Sequence
  Description of Artificial Sequence: Synthetic peptide
  MOD_RES (2)..(4): Any amino acid
NXXXR

SEQ ID NO: 834 - protein, 5 aa, Artificial Sequence
  Description of Artificial Sequence: Synthetic peptide
  MOD_RES (2)..(4): Any amino acid
RXXXD

SEQ ID NO: 835 - protein, 5 aa, Artificial Sequence
  Description of Artificial Sequence: Synthetic peptide
  MOD_RES (2)..(4): Any amino acid
EXXXN

SEQ ID NO: 836 - protein, 5 aa, Artificial Sequence
  Description of Artificial Sequence: Synthetic peptide
  MOD_RES (2)..(4): Any amino acid
EXXXS

SEQ ID NO: 837 - protein, 5 aa, Artificial Sequence
  Description of Artificial Sequence: Synthetic peptide
  MOD_RES (2)..(4): Any amino acid
YXXXN

SEQ ID NO: 838 - protein, 5 aa, Artificial Sequence
  Description of Artificial Sequence: Synthetic peptide
  MOD_RES (2)..(4): Any amino acid
AXXXE

SEQ ID NO: 839 - protein, 5 aa, Artificial Sequence
  Description of Artificial Sequence: Synthetic peptide
  MOD_RES (2)..(4): Any amino acid
QXXXA

SEQ ID NO: 840 - protein, 5 aa, Artificial Sequence
  Description of Artificial Sequence: Synthetic peptide
  MOD_RES (2)..(4): Any amino acid
QXXXL

SEQ ID NO: 841 - protein, 5 aa, Artificial Sequence
  Description of Artificial Sequence: Synthetic peptide
  MOD_RES (2)..(4): Any amino acid
NXXXQ

SEQ ID NO: 842 - protein, 5 aa, Artificial Sequence
  Description of Artificial Sequence: Synthetic peptide
  MOD_RES (2)..(4): Any amino acid
KXXXD

SEQ ID NO: 843 - protein, 5 aa, Artificial Sequence
  Description of Artificial Sequence: Synthetic peptide
  MOD_RES (2)..(4): Any amino acid
LXXXQ

SEQ ID NO: 844 - protein, 5 aa, Artificial Sequence
  Description of Artificial Sequence: Synthetic peptide
  MOD_RES (2)..(4): Any amino acid
YXXXR

SEQ ID NO: 845 - protein, 5 aa, Artificial Sequence
  Description of Artificial Sequence: Synthetic peptide
  MOD_RES (2)..(4): Any amino acid
PXXXR

SEQ ID NO: 846 - protein, 5 aa, Artificial Sequence
  Description of Artificial Sequence: Synthetic peptide
  MOD_RES (2)..(4): Any amino acid
RXXXA

SEQ ID NO: 847 - protein, 5 aa, Artificial Sequence
  Description of Artificial Sequence: Synthetic peptide
  MOD_RES (2)..(4): Any amino acid
YXXXK

SEQ ID NO: 848 - protein, 5 aa, Artificial Sequence
  Description of Artificial Sequence: Synthetic peptide
  MOD_RES (2)..(4): Any amino acid
TXXXQ

SEQ ID NO: 849 - protein, 5 aa, Artificial Sequence
  Description of Artificial Sequence: Synthetic peptide
  MOD_RES (2)..(4): Any amino acid
DXXXE

SEQ ID NO: 850 - protein, 5 aa, Artificial Sequence
  Description of Artificial Sequence: Synthetic peptide
  MOD_RES (2)..(4): Any amino acid
SXXXR

SEQ ID NO: 851 - protein, 5 aa, Artificial Sequence
  Description of Artificial Sequence: Synthetic peptide
  MOD_RES (2)..(4): Any amino acid
YXXXL

SEQ ID NO: 852 - protein, 5 aa, Artificial Sequence
  Description of Artificial Sequence: Synthetic peptide
  MOD_RES (2)..(4): Any amino acid
RXXXN

SEQ ID NO: 853 - protein, 5 aa, Artificial Sequence
  Description of Artificial Sequence: Synthetic peptide
  MOD_RES (2)..(4): Any amino acid
KXXXR

SEQ ID NO: 854 - protein, 5 aa, Artificial Sequence
  Description of Artificial Sequence: Synthetic peptide
  MOD_RES (2)..(4): Any amino acid
DXXXQ

SEQ ID NO: 855 - protein, 5 aa, Artificial Sequence
  Description of Artificial Sequence: Synthetic peptide
  MOD_RES (2)..(4): Any amino acid
SXXXQ

SEQ ID NO: 856 - protein, 5 aa, Artificial Sequence
  Description of Artificial Sequence: Synthetic peptide
  MOD_RES (2)..(4): Any amino acid
VXXXE

SEQ ID NO: 857 - protein, 5 aa, Artificial Sequence
  Description of Artificial Sequence: Synthetic peptide
  MOD_RES (2)..(4): Any amino acid
SXXXE

SEQ ID NO: 858 - protein, 5 aa, Artificial Sequence
  Description of Artificial Sequence: Synthetic peptide
  MOD_RES (2)..(4): Any amino acid
HXXXE

SEQ ID NO: 859 - protein, 5 aa, Artificial Sequence
  Description of Artificial Sequence: Synthetic peptide
  MOD_RES (2)..(4): Any amino acid
AXXXD

SEQ ID NO: 860 - protein, 5 aa, Artificial Sequence
  Description of Artificial Sequence: Synthetic peptide
  MOD_RES (2)..(4): Any amino acid
AXXXS

SEQ ID NO: 861 - protein, 5 aa, Artificial Sequence
  Description of Artificial Sequence: Synthetic peptide
  MOD_RES (2)..(4): Any amino acid
DXXXA

SEQ ID NO: 862 - protein, 5 aa, Artificial Sequence
  Description of Artificial Sequence: Synthetic peptide
  MOD_RES (2)..(4): Any amino acid
LXXXE

SEQ ID NO: 863 - protein, 5 aa, Artificial Sequence
  Description of Artificial Sequence: Synthetic peptide
  MOD_RES (2)..(4): Any amino acid
EXXXD

SEQ ID NO: 864 - protein, 5 aa, Artificial Sequence
  Description of Artificial Sequence: Synthetic peptide
  MOD_RES (2)..(4): Any amino acid
SXXXA

SEQ ID NO: 865 - protein, 5 aa, Artificial Sequence
  Description of Artificial Sequence: Synthetic peptide
  MOD_RES (2)..(4): Any amino acid
TXXXR

SEQ ID NO: 866 - protein, 5 aa, Artificial Sequence
  Description of Artificial Sequence: Synthetic peptide
  MOD_RES (2)..(4): Any amino acid
IXXXE

SEQ ID NO: 867 - protein, 5 aa, Artificial Sequence
  Description of Artificial Sequence: Synthetic peptide
  MOD_RES (2)..(4): Any amino acid
SXXXH

SEQ ID NO: 868 - protein, 5 aa, Artificial Sequence
  Description of Artificial Sequence: Synthetic peptide
  MOD_RES (2)..(4): Any amino acid
QXXXS

SEQ ID NO: 869 - protein, 5 aa, Artificial Sequence
  Description of Artificial Sequence: Synthetic peptide
  MOD_RES (2)..(4): Any amino acid
LXXXQ

SEQ ID NO: 870 - protein, 5 aa, Artificial Sequence
  Description of Artificial Sequence: Synthetic peptide
  MOD_RES (2)..(4): Any amino acid
PXXXA

SEQ ID NO: 871 - protein, 5 aa, Artificial Sequence
  Description of Artificial Sequence: Synthetic peptide
  MOD_RES (2)..(4): Any amino acid
FXXXQ

SEQ ID NO: 872 - protein, 5 aa, Artificial Sequence
  Description of Artificial Sequence: Synthetic peptide
  MOD_RES (2)..(4): Any amino acid
EXXXY

SEQ ID NO: 873 - protein, 5 aa, Artificial Sequence
  Description of Artificial Sequence: Synthetic peptide
  MOD_RES (2)..(4): Any amino acid
YXXXQ

SEQ ID NO: 874 - protein, 5 aa, Artificial Sequence
  Description of Artificial Sequence: Synthetic peptide
  MOD_RES (2)..(4): Any amino acid
KXXXQ

SEQ ID NO: 875 - protein, 5 aa, Artificial Sequence
  Description of Artificial Sequence: Synthetic peptide
  MOD_RES (2)..(4): Any amino acid
VXXXR

SEQ ID NO: 876 - protein, 5 aa, Artificial Sequence
  Description of Artificial Sequence: Synthetic peptide
  MOD_RES (2)..(4): Any amino acid
IXXXN

SEQ ID NO: 877 - protein, 5 aa, Artificial Sequence
  Description of Artificial Sequence: Synthetic peptide
  MOD_RES (2)..(4): Any amino acid
NXXXE

SEQ ID NO: 878 - protein, 5 aa, Artificial Sequence
  Description of Artificial Sequence: Synthetic peptide
  MOD_RES (2)..(4): Any amino acid
EXXXI

SEQ ID NO: 879 - protein, 5 aa, Artificial Sequence
  Description of Artificial Sequence: Synthetic peptide
  MOD_RES (2)..(4): Any amino acid
IXXXR

SEQ ID NO: 880 - protein, 5 aa, Artificial Sequence
  Description of Artificial Sequence: Synthetic peptide
  MOD_RES (2)..(4): Any amino acid
CXXXH

SEQ ID NO: 881 - protein, 5 aa, Artificial Sequence
  Description of Artificial Sequence: Synthetic peptide
  MOD_RES (2)..(4): Any amino acid
MXXXE

SEQ ID NO: 882 - protein, 5 aa, Artificial Sequence
  Description of Artificial Sequence: Synthetic peptide
  MOD_RES (2)..(4): Any amino acid
NXXXS

SEQ ID NO: 883 - protein, 5 aa, Artificial Sequence
  Description of Artificial Sequence: Synthetic peptide
  MOD_RES (2)..(4): Any amino acid
QXXXT

SEQ ID NO: 884 - protein, 5 aa, Artificial Sequence
  Description of Artificial Sequence: Synthetic peptide
  MOD_RES (2)..(4): Any amino acid
HXXXQ

SEQ ID NO: 885 - protein, 5 aa, Artificial Sequence
  Description of Artificial Sequence: Synthetic peptide
  MOD_RES (2)..(4): Any amino acid
VXXXN

SEQ ID NO: 886 - protein, 5 aa, Artificial Sequence
  Description of Artificial Sequence: Synthetic peptide
  MOD_RES (2)..(4): Any amino acid
DXXXS

SEQ ID NO: 887 - protein, 5 aa, Artificial Sequence
  Description of Artificial Sequence: Synthetic peptide
  MOD_RES (2)..(4): Any amino acid
DXXXD

SEQ ID NO: 888 - protein, 5 aa, Artificial Sequence
  Description of Artificial Sequence: Synthetic peptide
  MOD_RES (2)..(4): Any amino acid
SXXXS

SEQ ID NO: 889 - protein, 5 aa, Artificial Sequence
  Description of Artificial Sequence: Synthetic peptide
  MOD_RES (2)..(4): Any amino acid
PXXXE

SEQ ID NO: 890 - protein, 5 aa, Artificial Sequence
  Description of Artificial Sequence: Synthetic peptide
  MOD_RES (2)..(4): Any amino acid
FXXXR

SEQ ID NO: 891 - protein, 5 aa, Artificial Sequence
  Description of Artificial Sequence: Synthetic peptide
  MOD_RES (2)..(4): Any amino acid
TXXXE

SEQ ID NO: 892 - protein, 5 aa, Artificial Sequence
  Description of Artificial Sequence: Synthetic peptide
  MOD_RES (2)..(4): Any amino acid
WXXXQ

SEQ ID NO: 893 - protein, 5 aa, Artificial Sequence
  Description of Artificial Sequence: Synthetic peptide
  MOD_RES (2)..(4): Any amino acid
LXXXH

SEQ ID NO: 894 - protein, 5 aa, Artificial Sequence
  Description of Artificial Sequence: Synthetic peptide
  MOD_RES (2)..(4): Any amino acid
IXXXQ

SEQ ID NO: 895 - protein, 5 aa, Artificial Sequence
  Description of Artificial Sequence: Synthetic peptide
  MOD_RES (2)..(4): Any amino acid
DXXXK

SEQ ID NO: 896 - protein, 5 aa, Artificial Sequence
  Description of Artificial Sequence: Synthetic peptide
  MOD_RES (2)..(4): Any amino acid
EXXXT

SEQ ID NO: 897 - protein, 5 aa, Artificial Sequence
  Description of Artificial Sequence: Synthetic peptide
  MOD_RES (2)..(4): Any amino acid
RXXXK

SEQ ID NO: 898 - protein, 5 aa, Artificial Sequence
  Description of Artificial Sequence: Synthetic peptide
  MOD_RES (2)..(4): Any amino acid
NXXXN

SEQ ID NO: 899 - protein, 5 aa, Artificial Sequence
  Description of Artificial Sequence: Synthetic peptide
  MOD_RES (2)..(4): Any amino acid
HXXXR

SEQ ID NO: 900 - protein, 5 aa, Artificial Sequence
  Description of Artificial Sequence: Synthetic peptide
  MOD_RES (2)..(4): Any amino acid
NXXXL

SEQ ID NO: 901 - protein, 5 aa, Artificial Sequence
  Description of Artificial Sequence: Synthetic peptide
  MOD_RES (2)..(4): Any amino acid
SXXXN

SEQ ID NO: 902 - protein, 5 aa, Artificial Sequence
  Description of Artificial Sequence: Synthetic peptide
  MOD_RES (2)..(4): Any amino acid
DXXXN

SEQ ID NO: 903 - protein, 5 aa, Artificial Sequence
  Description of Artificial Sequence: Synthetic peptide
  MOD_RES (2)..(4): Any amino acid
EXXXH

SEQ ID NO: 904 - protein, 5 aa, Artificial Sequence
  Description of Artificial Sequence: Synthetic peptide
  MOD_RES (2)..(4): Any amino acid
YXXXE

SEQ ID NO: 905 - protein, 5 aa, Artificial Sequence
  Description of Artificial Sequence: Synthetic peptide
  MOD_RES (2)..(4): Any amino acid
LXXXN

SEQ ID NO: 906 - protein, 5 aa, Artificial Sequence
  Description of Artificial Sequence: Synthetic peptide
  MOD_RES (2)..(4): Any amino acid
PXXXQ

SEQ ID NO: 907 - protein, 5 aa, Artificial Sequence
  Description of Artificial Sequence: Synthetic peptide
  MOD_RES (2)..(4): Any amino acid
QXXXW

SEQ ID NO: 908 - protein, 5 aa, Artificial Sequence
  Description of Artificial Sequence: Synthetic peptide
  MOD_RES (2)..(4): Any amino acid
EXXXR

SEQ ID NO: 909 - protein, 5 aa, Artificial Sequence
  Description of Artificial Sequence: Synthetic peptide
  MOD_RES (2)..(4): Any amino acid
LXXXL

SEQ ID NO: 910 - protein, 5 aa, Artificial Sequence
  Description of Artificial Sequence: Synthetic peptide
  MOD_RES (2)..(3): Any amino acid
NXXDL

SEQ ID NO: 911 - protein, 5 aa, Artificial Sequence
  Description of Artificial Sequence: Synthetic peptide
  MOD_RES (2)..(3): Any amino acid
TXXGK

SEQ ID NO: 912 - protein, 5 aa, Artificial Sequence
  Description of Artificial Sequence: Synthetic peptide
  MOD_RES (2)..(3): Any amino acid
SXXYH

SEQ ID NO: 913 - protein, 5 aa, Artificial Sequence
  Description of Artificial Sequence: Synthetic peptide
  MOD_RES (2)..(3): Any amino acid
GXXKS

SEQ ID NO: 914 - protein, 5 aa, Artificial Sequence
  Description of Artificial Sequence: Synthetic peptide
  MOD_RES (2)..(3): Any amino acid
CXXCH

SEQ ID NO: 915 - protein, 5 aa, Artificial Sequence
  Description of Artificial Sequence: Synthetic peptide
  MOD_RES (2)..(3): Any amino acid
EXXRR

SEQ ID NO: 916 - protein, 5 aa, Artificial Sequence
  Description of Artificial Sequence: Synthetic peptide
  MOD_RES (2)..(3): Any amino acid
CXXCH

SEQ ID NO: 917 - protein, 5 aa, Artificial Sequence
  Description of Artificial Sequence: Synthetic peptide
  MOD_RES (2)..(3): Any amino acid
SXXGK

SEQ ID NO: 918 - protein, 5 aa, Artificial Sequence
  Description of Artificial Sequence: Synthetic peptide
  MOD_RES (2)..(3): Any amino acid
GXXKT

SEQ ID NO: 919 - protein, 5 aa, Artificial Sequence
  Description of Artificial Sequence: Synthetic peptide
  MOD_RES (2)..(3): Any amino acid
AXXAA

SEQ ID NO: 920 - protein, 5 aa, Artificial Sequence
  Description of Artificial Sequence: Synthetic peptide
  MOD_RES (2)..(3): Any amino acid
CXXCH

SEQ ID NO: 921 - protein, 5 aa, Artificial Sequence
  Description of Artificial Sequence: Synthetic peptide
  MOD_RES (2)..(3): Any amino acid
EXXRL

SEQ ID NO: 922 - protein, 5 aa, Artificial Sequence
  Description of Artificial Sequence: Synthetic peptide
  MOD_RES (2)..(3): Any amino acid
YXXEN

SEQ ID NO: 923 - protein, 5 aa, Artificial Sequence
  Description of Artificial Sequence: Synthetic peptide
  MOD_RES (2)..(3): Any amino acid
EXXRE

SEQ ID NO: 924 - protein, 5 aa, Artificial Sequence
  Description of Artificial Sequence: Synthetic peptide
  MOD_RES (2)..(3): Any amino acid
AXXTT

SEQ ID NO: 925 - protein, 5 aa, Artificial Sequence
  Description of Artificial Sequence: Synthetic peptide
  MOD_RES (2)..(3): Any amino acid
DXXRR

SEQ ID NO: 926 - protein, 5 aa, Artificial Sequence
  Description of Artificial Sequence: Synthetic peptide
  MOD_RES (2)..(3): Any amino acid
AXXRR

SEQ ID NO: 927 - protein, 5 aa, Artificial Sequence
  Description of Artificial Sequence: Synthetic peptide
  MOD_RES (2)..(3): Any amino acid
DXXGK

SEQ ID NO: 928 - protein, 5 aa, Artificial Sequence
  Description of Artificial Sequence: Synthetic peptide
  MOD_RES (2)..(3): Any amino acid
EXXRA

SEQ ID NO: 929 - protein, 5 aa, Artificial Sequence
  Description of Artificial Sequence: Synthetic peptide
  MOD_RES (2)..(3): Any amino acid
PXXGK

SEQ ID NO: 930 - protein, 5 aa, Artificial Sequence
  Description of Artificial Sequence: Synthetic peptide
  MOD_RES (2)..(3): Any amino acid
YXXGR

SEQ ID NO: 931 - protein, 5 aa, Artificial Sequence
  Description of Artificial Sequence: Synthetic peptide
  MOD_RES (2)..(3): Any amino acid
AXXER

SEQ ID NO: 932 - protein, 5 aa, Artificial Sequence
  Description of Artificial Sequence: Synthetic peptide
  MOD_RES (2)..(3): Any amino acid
CXXCW

SEQ ID NO: 933 - protein, 5 aa, Artificial Sequence
  Description of Artificial Sequence: Synthetic peptide
  MOD_RES (2)..(3): Any amino acid
QXXAA

SEQ ID NO: 934 - protein, 5 aa, Artificial Sequence
  Description of Artificial Sequence: Synthetic peptide
  MOD_RES (2)..(3): Any amino acid
HXXNE

SEQ ID NO: 935 - protein, 5 aa, Artificial Sequence
  Description of Artificial Sequence: Synthetic peptide
  MOD_RES (2)..(3): Any amino acid
RXXMD

SEQ ID NO: 936 - protein, 5 aa, Artificial Sequence
  Description of Artificial Sequence: Synthetic peptide
  MOD_RES (2)..(3): Any amino acid
NXXCK

SEQ ID NO: 937 - protein, 5 aa, Artificial Sequence
  Description of Artificial Sequence: Synthetic peptide
  MOD_RES (2)..(3): Any amino acid
AXXRA

SEQ ID NO: 938 - protein, 5 aa, Artificial Sequence
  Description of Artificial Sequence: Synthetic peptide
  MOD_RES (2)..(3): Any amino acid
EXXRQ

SEQ ID NO: 939 - protein, 5 aa, Artificial Sequence
  Description of Artificial Sequence: Synthetic peptide
  MOD_RES (2)..(3): Any amino acid
EXXAA

SEQ ID NO: 940 - protein, 5 aa, Artificial Sequence
  Description of Artificial Sequence: Synthetic peptide
  MOD_RES (2)..(3): Any amino acid
PXXNI

SEQ ID NO: 941 - protein, 5 aa, Artificial Sequence
  Description of Artificial Sequence: Synthetic peptide
  MOD_RES (2)..(3): Any amino acid
QXXEG

SEQ ID NO: 942 - protein, 5 aa, Artificial Sequence
  Description of Artificial Sequence: Synthetic peptide
  MOD_RES (2)..(3): Any amino acid
SXXAA

SEQ ID NO: 943 - protein, 5 aa, Artificial Sequence
  Description of Artificial Sequence: Synthetic peptide
  MOD_RES (2)..(3): Any amino acid
AXXAR

SEQ ID NO: 944 - protein, 5 aa, Artificial Sequence
  Description of Artificial Sequence: Synthetic peptide
  MOD_RES (2)..(3): Any amino acid
AXXSQ

SEQ ID NO: 945 - protein, 5 aa, Artificial Sequence
  Description of Artificial Sequence: Synthetic peptide
  MOD_RES (2)..(3): Any amino acid
AXXEA

SEQ ID NO: 946 - protein, 5 aa, Artificial Sequence
  Description of Artificial Sequence: Synthetic peptide
  MOD_RES (2)..(3): Any amino acid
GXXNS

SEQ ID NO: 947 - protein, 5 aa, Artificial Sequence
  Description of Artificial Sequence: Synthetic peptide
  MOD_RES (2)..(3): Any amino acid
NXXPN

SEQ ID NO: 948 - protein, 5 aa, Artificial Sequence
  Description of Artificial Sequence: Synthetic peptide
  MOD_RES (2)..(3): Any amino acid
SXXGN

SEQ ID NO: 949 - protein, 5 aa, Artificial Sequence
  Description of Artificial Sequence: Synthetic peptide
  MOD_RES (2)..(3): Any amino acid
YXXNF

SEQ ID NO: 950 - protein, 5 aa, Artificial Sequence
  Description of Artificial Sequence: Synthetic peptide
  MOD_RES (2)..(3): Any amino acid
SXXVD

SEQ ID NO: 951 - protein, 5 aa, Artificial Sequence
  Description of Artificial Sequence: Synthetic peptide
  MOD_RES (2)..(3): Any amino acid
EXXLA

SEQ ID NO: 952 - protein, 5 aa, Artificial Sequence
  Description of Artificial Sequence: Synthetic peptide
  MOD_RES (2)..(3): Any amino acid
HXXQA

SEQ ID NO: 953 - protein, 5 aa, Artificial Sequence
  Description of Artificial Sequence: Synthetic peptide
  MOD_RES (2)..(3): Any amino acid
EXXAA

SEQ ID NO: 954 - protein, 5 aa, Artificial Sequence
  Description of Artificial Sequence: Synthetic peptide
  MOD_RES (2)..(3): Any amino acid
TXXDK

SEQ ID NO: 955 - protein, 5 aa, Artificial Sequence
  Description of Artificial Sequence: Synthetic peptide
  MOD_RES (2)..(3): Any amino acid
RXXRE

SEQ ID NO: 956 - protein, 5 aa, Artificial Sequence
  Description of Artificial Sequence: Synthetic peptide
  MOD_RES (2)..(3): Any amino acid
VXXHE

SEQ ID NO: 957 - protein, 5 aa, Artificial Sequence
  Description of Artificial Sequence: Synthetic peptide
  MOD_RES (2)..(3): Any amino acid
KXXGA

SEQ ID NO: 958 - protein, 5 aa, Artificial Sequence
  Description of Artificial Sequence: Synthetic peptide
  MOD_RES (2)..(3): Any amino acid
RXXGI

SEQ ID NO: 959 - protein, 5 aa, Artificial Sequence
  Description of Artificial Sequence: Synthetic peptide
  MOD_RES (2)..(3): Any amino acid
AXXRT

SEQ ID NO: 960 - protein, 5 aa, Artificial Sequence
  Description of Artificial Sequence: Synthetic peptide
  MOD_RES (2)..(3): Any amino acid
VXXGA

SEQ ID NO: 961 - protein, 5 aa, Artificial Sequence
  Description of Artificial Sequence: Synthetic peptide
  MOD_RES (2)..(3): Any amino acid
KXXGF

SEQ ID NO: 962 - protein, 5 aa, Artificial Sequence
  Description of Artificial Sequence: Synthetic peptide
  MOD_RES (2)..(3): Any amino acid
AXXRD

SEQ ID NO: 963 - protein, 5 aa, Artificial Sequence
  Description of Artificial Sequence: Synthetic peptide
  MOD_RES (2)..(3): Any amino acid
CXXCH

SEQ ID NO: 964 - protein, 5 aa, Artificial Sequence
  Description of Artificial Sequence: Synthetic peptide
  MOD_RES (2)..(3): Any amino acid
AXXAS

SEQ ID NO: 965 - protein, 5 aa, Artificial Sequence
  Description of Artificial Sequence: Synthetic peptide
  MOD_RES (2)..(3): Any amino acid
AXXAE

SEQ ID NO: 966 - protein, 5 aa, Artificial Sequence
  Description of Artificial Sequence: Synthetic peptide
  MOD_RES (2)..(3): Any amino acid
SXXGL

SEQ ID NO: 967 - protein, 5 aa, Artificial Sequence
  Description of Artificial Sequence: Synthetic peptide
  MOD_RES (2)..(3): Any amino acid
EXXGL

SEQ ID NO: 968 - protein, 5 aa, Artificial Sequence
  Description of Artificial Sequence: Synthetic peptide
  MOD_RES (2)..(3): Any amino acid
VXXKN

SEQ ID NO: 969 - protein, 5 aa, Artificial Sequence
  Description of Artificial Sequence: Synthetic peptide
  MOD_RES (2)..(3): Any amino acid
LXXLH

SEQ ID NO: 970 - protein, 5 aa, Artificial Sequence
  Description of Artificial Sequence: Synthetic peptide
  MOD_RES (2)..(3): Any amino acid
AXXRE

SEQ ID NO: 971 - protein, 5 aa, Artificial Sequence
  Description of Artificial Sequence: Synthetic peptide
  MOD_RES (2)..(3): Any amino acid
EXXLS

SEQ ID NO: 972 - protein, 5 aa, Artificial Sequence
  Description of Artificial Sequence: Synthetic peptide
  MOD_RES (2)..(3): Any amino acid
EXXGA

SEQ ID NO: 973 - protein, 5 aa, Artificial Sequence
  Description of Artificial Sequence: Synthetic peptide
  MOD_RES (2)..(3): Any amino acid
KXXAC

SEQ ID NO: 974 - protein, 5 aa, Artificial Sequence
  Description of Artificial Sequence: Synthetic peptide
  MOD_RES (2)..(3): Any amino acid
HXXKV

SEQ ID NO: 975 - protein, 5 aa, Artificial Sequence
  Description of Artificial Sequence: Synthetic peptide
  MOD_RES (2)..(3): Any amino acid
AXXAA

SEQ ID NO: 976 - protein, 5 aa, Artificial Sequence
  Description of Artificial Sequence: Synthetic peptide
  MOD_RES (2)..(3): Any amino acid
AXXGL

SEQ ID NO: 977 - protein, 5 aa, Artificial Sequence
  Description of Artificial Sequence: Synthetic peptide
  MOD_RES (2)..(3): Any amino acid
SXXTT

SEQ ID NO: 978 - protein, 5 aa, Artificial Sequence
  Description of Artificial Sequence: Synthetic peptide
  MOD_RES (2)..(3): Any amino acid
AXXRH

SEQ ID NO: 979 - protein, 5 aa, Artificial Sequence
  Description of Artificial Sequence: Synthetic peptide
  MOD_RES (2)..(3): Any amino acid
RXXGL

SEQ ID NO: 980 - protein, 5 aa, Artificial Sequence
  Description of Artificial Sequence: Synthetic peptide
  MOD_RES (2)..(3): Any amino acid
CXXCH

SEQ ID NO: 981 - protein, 5 aa, Artificial Sequence
  Description of Artificial Sequence: Synthetic peptide
  MOD_RES (2)..(3): Any amino acid
AXXAQ

SEQ ID NO: 982 - protein, 5 aa, Artificial Sequence
  Description of Artificial Sequence: Synthetic peptide
  MOD_RES (2)..(3): Any amino acid
LXXNV

SEQ ID NO: 983 - protein, 5 aa, Artificial Sequence
  Description of Artificial Sequence: Synthetic peptide
  MOD_RES (2)..(3): Any amino acid
AXXQD

SEQ ID NO: 984 - protein, 5 aa, Artificial Sequence
  Description of Artificial Sequence: Synthetic peptide
  MOD_RES (2)..(3): Any amino acid
GXXGK

SEQ ID NO: 985 - protein, 5 aa, Artificial Sequence
  Description of Artificial Sequence: Synthetic peptide
  MOD_RES (2)..(3): Any amino acid
MXXCT

SEQ ID NO: 986 - protein, 5 aa, Artificial Sequence
  Description of Artificial Sequence: Synthetic peptide
  MOD_RES (2)..(3): Any amino acid
PXXAA

SEQ ID NO: 987 - protein, 5 aa, Artificial Sequence
  Description of Artificial Sequence: Synthetic peptide
  MOD_RES (2)..(3): Any amino acid
NXXHQ

SEQ ID NO: 988 - protein, 5 aa, Artificial Sequence
  Description of Artificial Sequence: Synthetic peptide
  MOD_RES (2)..(3): Any amino acid
MXXSR

SEQ ID NO: 989 - protein, 5 aa, Artificial Sequence
  Description of Artificial Sequence: Synthetic peptide
  MOD_RES (2)..(3): Any amino acid
KXXDG

SEQ ID NO: 990 - protein, 5 aa, Artificial Sequence
  Description of Artificial Sequence: Synthetic peptide
  MOD_RES (2)..(3): Any amino acid
DXXRA

SEQ ID NO: 991 - protein, 5 aa, Artificial Sequence
  Description of Artificial Sequence: Synthetic peptide
  MOD_RES (2)..(3): Any amino acid
DXXRN

SEQ ID NO: 992 - protein, 5 aa, Artificial Sequence
  Description of Artificial Sequence: Synthetic peptide
  MOD_RES (2)..(3): Any amino acid
AXXQA

SEQ ID NO: 993 - protein, 5 aa, Artificial Sequence
  Description of Artificial Sequence: Synthetic peptide
  MOD_RES (2)..(3): Any amino acid
DXXSN

SEQ ID NO: 994 - protein, 5 aa, Artificial Sequence
  Description of Artificial Sequence: Synthetic peptide
  MOD_RES (2)..(3): Any amino acid
NXXRN

SEQ ID NO: 995 - protein, 5 aa, Artificial Sequence
  Description of Artificial Sequence: Synthetic peptide
  MOD_RES (2)..(3): Any amino acid
EXXLP

SEQ ID NO: 996 - protein, 5 aa, Artificial Sequence
  Description of Artificial Sequence: Synthetic peptide
  MOD_RES (2)..(3): Any amino acid
CXXNI

SEQ ID NO: 997 - protein, 5 aa, Artificial Sequence
  Description of Artificial Sequence: Synthetic peptide
  MOD_RES (2)..(3): Any amino acid
VXXTS

SEQ ID NO: 998 - protein, 5 aa, Artificial Sequence
  Description of Artificial Sequence: Synthetic peptide
  MOD_RES (2)..(3): Any amino acid
CXXCH

SEQ ID NO: 999 - protein, 5 aa, Artificial Sequence
  Description of Artificial Sequence: Synthetic peptide
  MOD_RES (2)..(3): Any amino acid
CXXCW

SEQ ID NO: 1000 - protein, 5 aa, Artificial Sequence
  Description of Artificial Sequence: Synthetic peptide
  MOD_RES (2)..(3): Any amino acid
QXXMS

SEQ ID NO: 1001 - protein, 5 aa, Artificial Sequence
  Description of Artificial Sequence: Synthetic peptide
  MOD_RES (2)..(3): Any amino acid
PXXLT

SEQ ID NO: 1002 - protein, 5 aa, Artificial Sequence
  Description of Artificial Sequence: Synthetic peptide
  MOD_RES (2)..(3): Any amino acid
AXXQQ

SEQ ID NO: 1003 - protein, 5 aa, Artificial Sequence
  Description of Artificial Sequence: Synthetic peptide
  MOD_RES (2)..(3): Any amino acid
GXXAA

SEQ ID NO: 1004 - protein, 5 aa, Artificial Sequence
  Description of Artificial Sequence: Synthetic peptide
  MOD_RES (2)..(3): Any amino acid
AXXGR

SEQ ID NO: 1005 - protein, 5 aa, Artificial Sequence
  Description of Artificial Sequence: Synthetic peptide
  MOD_RES (2)..(3): Any amino acid
AXXDA

SEQ ID NO: 1006 - protein, 5 aa, Artificial Sequence
  Description of Artificial Sequence: Synthetic peptide
  MOD_RES (2)..(3): Any amino acid
QXXGL

SEQ ID NO: 1007 - protein, 5 aa, Artificial Sequence
  Description of Artificial Sequence: Synthetic peptide
  MOD_RES (2)..(3): Any amino acid
SXXDS

SEQ ID NO: 1008 - protein, 5 aa, Artificial Sequence
  Description of Artificial Sequence: Synthetic peptide
  MOD_RES (2)..(3): Any amino acid
QXXND

SEQ ID NO: 1009 - protein, 5 aa, Artificial Sequence
  Description of Artificial Sequence: Synthetic peptide
  MOD_RES (2)..(2): Any amino acid
  MOD_RES (4)..(4): Any amino acid
GXGXS

SEQ ID NO: 1010 - protein, 5 aa, Artificial Sequence
  Description of Artificial Sequence: Synthetic peptide
  MOD_RES (2)..(2): Any amino acid
  MOD_RES (4)..(4): Any amino acid
GXGXT

SEQ ID NO: 1011 - protein, 5 aa, Artificial Sequence
  Description of Artificial Sequence: Synthetic peptide
  MOD_RES (2)..(2): Any amino acid
  MOD_RES (4)..(4): Any amino acid
AXKXT

SEQ ID NO: 1012 - protein, 5 aa, Artificial Sequence
  Description of Artificial Sequence: Synthetic peptide
  MOD_RES (2)..(2): Any amino acid
  MOD_RES (4)..(4): Any amino acid
SXKXT

SEQ ID NO: 1013 - protein, 5 aa, Artificial Sequence
  Description of Artificial Sequence: Synthetic peptide
  MOD_RES (2)..(2): Any amino acid
  MOD_RES (4)..(4): Any amino acid
VXKXS

SEQ ID NO: 1014 - protein, 5 aa, Artificial Sequence
  Description of Artificial Sequence: Synthetic peptide
  MOD_RES (2)..(2): Any amino acid
  MOD_RES (4)..(4): Any amino acid
GXGXG

SEQ ID NO: 1015 - protein, 5 aa, Artificial Sequence
  Description of Artificial Sequence: Synthetic peptide
  MOD_RES (2)..(2): Any amino acid
  MOD_RES (4)..(4): Any amino acid
TXVXK

SEQ ID NO: 1016 - protein, 5 aa, Artificial Sequence
  Description of Artificial Sequence: Synthetic peptide
  MOD_RES (2)..(2): Any amino acid
  MOD_RES (4)..(4): Any amino acid
SXKXD

SEQ ID NO: 1017 - protein, 5 aa, Artificial Sequence
  Description of Artificial Sequence: Synthetic peptide
  MOD_RES (2)..(2): Any amino acid
  MOD_RES (4)..(4): Any amino acid
TXTXK

SEQ ID NO: 1018 - protein, 5 aa, Artificial Sequence
  Description of Artificial Sequence: Synthetic peptide
  MOD_RES (2)..(2): Any amino acid
  MOD_RES (4)..(4): Any amino acid
VXCXN

SEQ ID NO: 1019 - protein, 5 aa, Artificial Sequence
  Description of Artificial Sequence: Synthetic peptide
  MOD_RES (2)..(2): Any amino acid
  MOD_RES (4)..(4): Any amino acid
SXVXK

SEQ ID NO: 1020 - protein, 5 aa, Artificial Sequence
  Description of Artificial Sequence: Synthetic peptide
  MOD_RES (2)..(2): Any amino acid
  MOD_RES (4)..(4): Any amino acid
GXTXS

SEQ ID NO: 1021 - protein, 5 aa, Artificial Sequence
  Description of Artificial Sequence: Synthetic peptide
  MOD_RES (2)..(2): Any amino acid
  MOD_RES (4)..(4): Any amino acid
QXGXT

SEQ ID NO: 1022 - protein, 5 aa, Artificial Sequence
  Description of Artificial Sequence: Synthetic peptide
  MOD_RES (2)..(2): Any amino acid
  MOD_RES (4)..(4): Any amino acid
DXAXK

SEQ ID NO: 1023 - protein, 5 aa, Artificial Sequence
  Description of Artificial Sequence: Synthetic peptide
  MOD_RES (2)..(2): Any amino acid
  MOD_RES (4)..(4): Any amino acid
KXDXK

SEQ ID NO: 1024 - protein, 5 aa, Artificial Sequence
  Description of Artificial Sequence: Synthetic peptide
  MOD_RES (2)..(2): Any amino acid
  MOD_RES (4)..(4): Any amino acid
SXTXV

SEQ ID NO: 1025 - protein, 5 aa, Artificial Sequence
  Description of Artificial Sequence: Synthetic peptide
  MOD_RES (2)..(2): Any amino acid
  MOD_RES (4)..(4): Any amino acid
SXTXN

SEQ ID NO: 1026 - protein, 5 aa, Artificial Sequence
  Description of Artificial Sequence: Synthetic peptide
  MOD_RES (2)..(2): Any amino acid
  MOD_RES (4)..(4): Any amino acid
QXPXS

SEQ ID NO: 1027 - protein, 5 aa, Artificial Sequence
  Description of Artificial Sequence: Synthetic peptide
  MOD_RES (2)..(2): Any amino acid
  MOD_RES (4)..(4): Any amino acid
QXKXG

SEQ ID NO: 1028 - protein, 5 aa, Artificial Sequence
  Description of Artificial Sequence: Synthetic peptide
  MOD_RES (2)..(2): Any amino acid
  MOD_RES (4)..(4): Any amino acid
KXVXC

SEQ ID NO: 1029 - protein, 5 aa, Artificial Sequence
  Description of Artificial Sequence: Synthetic peptide
  MOD_RES (2)..(2): Any amino acid
  MOD_RES (4)..(4): Any amino acid
NXAXK

SEQ ID NO: 1030 - protein, 5 aa, Artificial Sequence
  Description of Artificial Sequence: Synthetic peptide
  MOD_RES (2)..(2): Any amino acid
  MOD_RES (4)..(4): Any amino acid
GXTXY

SEQ ID NO: 1031 - protein, 5 aa, Artificial Sequence
  Description of Artificial Sequence: Synthetic peptide
  MOD_RES (2)..(2): Any amino acid
  MOD_RES (4)..(4): Any amino acid
RXKXG

SEQ ID NO: 1032 - protein, 5 aa, Artificial Sequence
  Description of Artificial Sequence: Synthetic peptide
  MOD_RES (2)..(2): Any amino acid
  MOD_RES (4)..(4): Any amino acid
AXGXR

SEQ ID NO: 1033 - protein, 5 aa, Artificial Sequence
  Description of Artificial Sequence: Synthetic peptide
  MOD_RES (2)..(2): Any amino acid
  MOD_RES (4)..(4): Any amino acid
SXGXG

SEQ ID NO: 1034 - protein, 5 aa, Artificial Sequence
  Description of Artificial Sequence: Synthetic peptide
  MOD_RES (2)..(2): Any amino acid
  MOD_RES (4)..(4): Any amino acid
NXGXT

SEQ ID NO: 1035 - protein, 5 aa, Artificial Sequence
  Description of Artificial Sequence: Synthetic peptide
  MOD_RES (2)..(2): Any amino acid
  MOD_RES (4)..(4): Any amino acid
PXWXI

SEQ ID NO: 1036 - protein, 5 aa, Artificial Sequence
  Description of Artificial Sequence: Synthetic peptide
  MOD_RES (2)..(2): Any amino acid
  MOD_RES (4)..(4): Any amino acid
SXGXG

SEQ ID NO: 1037 - protein, 5 aa, Artificial Sequence
  Description of Artificial Sequence: Synthetic peptide
  MOD_RES (2)..(2): Any amino acid
  MOD_RES (4)..(4): Any amino acid
TXMXF

SEQ ID NO: 1038 - protein, 5 aa, Artificial Sequence
  Description of Artificial Sequence: Synthetic peptide
  MOD_RES (2)..(2): Any amino acid
  MOD_RES (4)..(4): Any amino acid
GXSXE

SEQ ID NO: 1039 - protein, 5 aa, Artificial Sequence
  Description of Artificial Sequence: Synthetic peptide
  MOD_RES (2)..(2): Any amino acid
  MOD_RES (4)..(4): Any amino acid
RXRXG

SEQ ID NO: 1040 - protein, 5 aa, Artificial Sequence
  Description of Artificial Sequence: Synthetic peptide
  MOD_RES (2)..(2): Any amino acid
  MOD_RES (4)..(4): Any amino acid
CXAXI

SEQ ID NO: 1041 - protein, 5 aa, Artificial Sequence
  Description of Artificial Sequence: Synthetic peptide
  MOD_RES (2)..(2): Any amino acid
  MOD_RES (4)..(4): Any amino acid
RXSXT

SEQ ID NO: 1042 - protein, 5 aa, Artificial Sequence
  Description of Artificial Sequence: Synthetic peptide
  MOD_RES (2)..(2): Any amino acid
  MOD_RES (4)..(4): Any amino acid
QXNXQ

SEQ ID NO: 1043 - protein, 5 aa, Artificial Sequence
  Description of Artificial Sequence: Synthetic peptide
  MOD_RES (2)..(2): Any amino acid
  MOD_RES (4)..(4): Any amino acid
AXGXT

SEQ ID NO: 1044 - protein, 5 aa, Artificial Sequence
  Description of Artificial Sequence: Synthetic peptide
  MOD_RES (2)..(2): Any amino acid
  MOD_RES (4)..(4): Any amino acid
CXGXH

SEQ ID NO: 1045 - protein, 5 aa, Artificial Sequence
  Description of Artificial Sequence: Synthetic peptide
  MOD_RES (2)..(2): Any amino acid
  MOD_RES (4)..(4): Any amino acid
QXGXC

SEQ ID NO: 1046 - protein, 5 aa, Artificial Sequence
  Description of Artificial Sequence: Synthetic peptide
  MOD_RES (2)..(2): Any amino acid
  MOD_RES (4)..(4): Any amino acid
QXNXN

SEQ ID NO: 1047 - protein, 5 aa, Artificial Sequence
  Description of Artificial Sequence: Synthetic peptide
  MOD_RES (2)..(2): Any amino acid
  MOD_RES (4)..(4): Any amino acid
NXKXD

SEQ ID NO: 1048 - protein, 5 aa, Artificial Sequence
  Description of Artificial Sequence: Synthetic peptide
  MOD_RES (2)..(2): Any amino acid
  MOD_RES (4)..(4): Any amino acid
QXPXR

SEQ ID NO: 1049 - protein, 5 aa, Artificial Sequence
  Description of Artificial Sequence: Synthetic peptide
  MOD_RES (2)..(2): Any amino acid
  MOD_RES (4)..(4): Any amino acid
YXSXR

SEQ ID NO: 1050 - protein, 5 aa, Artificial Sequence
  Description of Artificial Sequence: Synthetic peptide
  MOD_RES (2)..(2): Any amino acid
  MOD_RES (4)..(4): Any amino acid
MXIXE

SEQ ID NO: 1051 - protein, 5 aa, Artificial Sequence
  Description of Artificial Sequence: Synthetic peptide
  MOD_RES (2)..(2): Any amino acid
  MOD_RES (4)..(4): Any amino acid
GXTXW

SEQ ID NO: 1052 - protein, 5 aa, Artificial Sequence
  Description of Artificial Sequence: Synthetic peptide
  MOD_RES (2)..(2): Any amino acid
  MOD_RES (4)..(4): Any amino acid
GXEXF

SEQ ID NO: 1053 - protein, 5 aa, Artificial Sequence
  Description of Artificial Sequence: Synthetic peptide
  MOD_RES (2)..(2): Any amino acid
  MOD_RES (4)..(4): Any amino acid
DXNXE

SEQ ID NO: 1054 - protein, 5 aa, Artificial Sequence
  Description of Artificial Sequence: Synthetic peptide
  MOD_RES (2)..(2): Any amino acid
  MOD_RES (4)..(4): Any amino acid
VXKXC

SEQ ID NO: 1055 - protein, 5 aa, Artificial Sequence
  Description of Artificial Sequence: Synthetic peptide
  MOD_RES (2)..(2): Any amino acid
  MOD_RES (4)..(4): Any amino acid
HXNXR

SEQ ID NO: 1056 - protein, 5 aa, Artificial Sequence
  Description of Artificial Sequence: Synthetic peptide
  MOD_RES (2)..(2): Any amino acid
  MOD_RES (4)..(4): Any amino acid
CXNXQ

SEQ ID NO: 1057 - protein, 5 aa, Artificial Sequence
  Description of Artificial Sequence: Synthetic peptide
  MOD_RES (2)..(2): Any amino acid
  MOD_RES (4)..(4): Any amino acid
AXVXR

SEQ ID NO: 1058 - protein, 5 aa, Artificial Sequence
  Description of Artificial Sequence: Synthetic peptide
  MOD_RES (2)..(2): Any amino acid
  MOD_RES (4)..(4): Any amino acid
KXGXT

SEQ ID NO: 1059 - protein, 5 aa, Artificial Sequence
  Description of Artificial Sequence: Synthetic peptide
  MOD_RES (2)..(2): Any amino acid
  MOD_RES (4)..(4): Any amino acid
DXDXT

SEQ ID NO: 1060 - protein, 5 aa, Artificial Sequence
  Description of Artificial Sequence: Synthetic peptide
  MOD_RES (2)..(2): Any amino acid
  MOD_RES (4)..(4): Any amino acid
EXGXS

SEQ ID NO: 1061 - protein, 5 aa, Artificial Sequence
  Description of Artificial Sequence: Synthetic peptide
  MOD_RES (2)..(2): Any amino acid
  MOD_RES (4)..(4): Any amino acid
PXHXA

SEQ ID NO: 1062 - protein, 5 aa, Artificial Sequence
  Description of Artificial Sequence: Synthetic peptide
  MOD_RES (2)..(2): Any amino acid
  MOD_RES (4)..(4): Any amino acid
GXLXL

SEQ ID NO: 1063 - protein, 5 aa, Artificial Sequence
  Description of Artificial Sequence: Synthetic peptide
  MOD_RES (2)..(2): Any amino acid
  MOD_RES (4)..(4): Any amino acid
CXGXI

SEQ ID NO: 1064 - protein, 5 aa, Artificial Sequence
  Description of Artificial Sequence: Synthetic peptide
  MOD_RES (2)..(2): Any amino acid
  MOD_RES (4)..(4): Any amino acid
QXQXN

SEQ ID NO: 1065 - protein, 5 aa, Artificial Sequence
  Description of Artificial Sequence: Synthetic peptide
  MOD_RES (2)..(2): Any amino acid
  MOD_RES (4)..(4): Any amino acid
NXGXM

SEQ ID NO: 1066 - protein, 5 aa, Artificial Sequence
  Description of Artificial Sequence: Synthetic peptide
  MOD_RES (2)..(2): Any amino acid
  MOD_RES (4)..(4): Any amino acid
MXLXT

SEQ ID NO: 1067 - protein, 5 aa, Artificial Sequence
  Description of Artificial Sequence: Synthetic peptide
  MOD_RES (2)..(2): Any amino acid
  MOD_RES (4)..(4): Any amino acid
DXNXY

SEQ ID NO: 1068 - protein, 5 aa, Artificial Sequence
  Description of Artificial Sequence: Synthetic peptide
  MOD_RES (2)..(2): Any amino acid
  MOD_RES (4)..(4): Any amino acid
TXKXT

SEQ ID NO: 1069 - protein, 5 aa, Artificial Sequence
  Description of Artificial Sequence: Synthetic peptide
  MOD_RES (2)..(2): Any amino acid
  MOD_RES (4)..(4): Any amino acid
YXHXC

SEQ ID NO: 1070 - protein, 5 aa, Artificial Sequence
  Description of Artificial Sequence: Synthetic peptide
  MOD_RES (2)..(2): Any amino acid
  MOD_RES (4)..(4): Any amino acid
DXPXY

SEQ ID NO: 1071 - protein, 5 aa, Artificial Sequence
  Description of Artificial Sequence: Synthetic peptide
  MOD_RES (2)..(2): Any amino acid
  MOD_RES (4)..(4): Any amino acid
DXGXG

SEQ ID NO: 1072 - protein, 5 aa, Artificial Sequence
  Description of Artificial Sequence: Synthetic peptide
  MOD_RES (2)..(2): Any amino acid
  MOD_RES (4)..(4): Any amino acid
NXTXN

SEQ ID NO: 1073 - protein, 5 aa, Artificial Sequence
  Description of Artificial Sequence: Synthetic peptide
  MOD_RES (2)..(2): Any amino acid
  MOD_RES (4)..(4): Any amino acid
PXSXK

SEQ ID NO: 1074 - protein, 5 aa, Artificial Sequence
  Description of Artificial Sequence: Synthetic peptide
  MOD_RES (2)..(2): Any amino acid
  MOD_RES (4)..(4): Any amino acid
AXIXR

SEQ ID NO: 1075 - protein, 5 aa, Artificial Sequence
  Description of Artificial Sequence: Synthetic peptide
  MOD_RES (2)..(2): Any amino acid
  MOD_RES (4)..(4): Any amino acid
CXGXS

SEQ ID NO: 1076 - protein, 5 aa, Artificial Sequence
  Description of Artificial Sequence: Synthetic peptide
  MOD_RES (2)..(2): Any amino acid
  MOD_RES (4)..(4): Any amino acid
TXPXG

SEQ ID NO: 1077 - protein, 5 aa, Artificial Sequence
  Description of Artificial Sequence: Synthetic peptide
  MOD_RES (2)..(2): Any amino acid
  MOD_RES (4)..(4): Any amino acid
GXLXH

SEQ ID NO: 1078 - protein, 5 aa, Artificial Sequence
  Description of Artificial Sequence: Synthetic peptide
  MOD_RES (2)..(2): Any amino acid
  MOD_RES (4)..(4): Any amino acid
NXGXH

SEQ ID NO: 1079 - protein, 5 aa, Artificial Sequence
  Description of Artificial Sequence: Synthetic peptide
  MOD_RES (2)..(2): Any amino acid
  MOD_RES (4)..(4): Any amino acid
GXVXK

SEQ ID NO: 1080 - protein, 5 aa, Artificial Sequence
  Description of Artificial Sequence: Synthetic peptide
  MOD_RES (2)..(2): Any amino acid
  MOD_RES (4)..(4): Any amino acid
DXLXA

SEQ ID NO: 1081 - protein, 5 aa, Artificial Sequence
  Description of Artificial Sequence: Synthetic peptide
  MOD_RES (2)..(2): Any amino acid
  MOD_RES (4)..(4): Any amino acid
VXKXA

SEQ ID NO: 1082 - protein, 5 aa, Artificial Sequence
  Description of Artificial Sequence: Synthetic peptide
  MOD_RES (2)..(2): Any amino acid
  MOD_RES (4)..(4): Any amino acid
TXAXK

SEQ ID NO: 1083 - protein, 5 aa, Artificial Sequence
  Description of Artificial Sequence: Synthetic peptide
  MOD_RES (2)..(2): Any amino acid
  MOD_RES (4)..(4): Any amino acid
VXPXY

SEQ ID NO: 1084 - protein, 5 aa, Artificial Sequence
  Description of Artificial Sequence: Synthetic peptide
  MOD_RES (2)..(2): Any amino acid
  MOD_RES (4)..(4): Any amino acid
NXGXM

SEQ ID NO: 1085 - protein, 5 aa, Artificial Sequence
  Description of Artificial Sequence: Synthetic peptide
  MOD_RES (2)..(2): Any amino acid
  MOD_RES (4)..(4): Any amino acid
KXNXY

SEQ ID NO: 1086 - protein, 5 aa, Artificial Sequence
  Description of Artificial Sequence: Synthetic peptide
  MOD_RES (2)..(2): Any amino acid
  MOD_RES (4)..(4): Any amino acid
NXFXV

SEQ ID NO: 1087 - protein, 5 aa, Artificial Sequence
  Description of Artificial Sequence: Synthetic peptide
  MOD_RES (2)..(2): Any amino acid
  MOD_RES (4)..(4): Any amino acid
GXSXL

SEQ ID NO: 1088 - protein, 5 aa, Artificial Sequence
  Description of Artificial Sequence: Synthetic peptide
  MOD_RES (2)..(2): Any amino acid
  MOD_RES (4)..(4): Any amino acid
CXSXW

SEQ ID NO: 1089 - protein, 5 aa, Artificial Sequence
  Description of Artificial Sequence: Synthetic peptide
  MOD_RES (2)..(2): Any amino acid
  MOD_RES (4)..(4): Any amino acid
LXPXE

SEQ ID NO: 1090 - protein, 5 aa, Artificial Sequence
  Description of Artificial Sequence: Synthetic peptide
  MOD_RES (2)..(2): Any amino acid
  MOD_RES (4)..(4): Any amino acid
CXQXT

SEQ ID NO: 1091 - protein, 5 aa, Artificial Sequence
  Description of Artificial Sequence: Synthetic peptide
  MOD_RES (2)..(2): Any amino acid
  MOD_RES (4)..(4): Any amino acid
SXSXN

SEQ ID NO: 1092 - protein, 5 aa, Artificial Sequence
  Description of Artificial Sequence: Synthetic peptide
  MOD_RES (2)..(2): Any amino acid
  MOD_RES (4)..(4): Any amino acid
QXRXY

SEQ ID NO: 1093 - protein, 5 aa, Artificial Sequence
  Description of Artificial Sequence: Synthetic peptide
  MOD_RES (2)..(2): Any amino acid
  MOD_RES (4)..(4): Any amino acid
CXAXH

SEQ ID NO: 1094 - protein, 5 aa, Artificial Sequence
  Description of Artificial Sequence: Synthetic peptide
  MOD_RES (2)..(2): Any amino acid
  MOD_RES (4)..(4): Any amino acid
NXGXS

SEQ ID NO: 1095 - protein, 5 aa, Artificial Sequence
  Description of Artificial Sequence: Synthetic peptide
  MOD_RES (2)..(2): Any amino acid
  MOD_RES (4)..(4): Any amino acid
LXFXI

SEQ ID NO: 1096 - protein, 5 aa, Artificial Sequence
  Description of Artificial Sequence: Synthetic peptide
  MOD_RES (2)..(2): Any amino acid
  MOD_RES (4)..(4): Any amino acid
NXQXQ

SEQ ID NO: 1097 - protein, 5 aa, Artificial Sequence
  Description of Artificial Sequence: Synthetic peptide
  MOD_RES (2)..(2): Any amino acid
  MOD_RES (4)..(4): Any amino acid
LXVXY

SEQ ID NO: 1098 - protein, 5 aa, Artificial Sequence
  Description of Artificial Sequence: Synthetic peptide
  MOD_RES (2)..(2): Any amino acid
  MOD_RES (4)..(4): Any amino acid
AXIXR

SEQ ID NO: 1099 - protein, 5 aa, Artificial Sequence
  Description of Artificial Sequence: Synthetic peptide
  MOD_RES (2)..(2): Any amino acid
  MOD_RES (4)..(4): Any amino acid
PXVXK

SEQ ID NO: 1100 - protein, 5 aa, Artificial Sequence
  Description of Artificial Sequence: Synthetic peptide
  MOD_RES (2)..(2): Any amino acid
  MOD_RES (4)..(4): Any amino acid
GXWXT

SEQ ID NO: 1101 - protein, 5 aa, Artificial Sequence
  Description of Artificial Sequence: Synthetic peptide
  MOD_RES (2)..(2): Any amino acid
  MOD_RES (4)..(4): Any amino acid
SXGXN

SEQ ID NO: 1102 - protein, 5 aa, Artificial Sequence
  Description of Artificial Sequence: Synthetic peptide
  MOD_RES (2)..(2): Any amino acid
  MOD_RES (4)..(4): Any amino acid
KXWXE

SEQ ID NO: 1103 - protein, 5 aa, Artificial Sequence
  Description of Artificial Sequence: Synthetic peptide
  MOD_RES (2)..(2): Any amino acid
  MOD_RES (4)..(4): Any amino acid
HXGXI

SEQ ID NO: 1104 - protein, 5 aa, Artificial Sequence
  Description of Artificial Sequence: Synthetic peptide
  MOD_RES (2)..(2): Any amino acid
  MOD_RES (4)..(4): Any amino acid
GXDXS

SEQ ID NO: 1105 - protein, 5 aa, Artificial Sequence
  Description of Artificial Sequence: Synthetic peptide
  MOD_RES (2)..(2): Any amino acid
  MOD_RES (4)..(4): Any amino acid
DXGXT

SEQ ID NO: 1106 - protein, 5 aa, Artificial Sequence
  Description of Artificial Sequence: Synthetic peptide
  MOD_RES (2)..(2): Any amino acid
  MOD_RES (4)..(4): Any amino acid
EXCXL

SEQ ID NO: 1107 - protein, 5 aa, Artificial Sequence
  Description of Artificial Sequence: Synthetic peptide
  MOD_RES (2)..(2): Any amino acid
  MOD_RES (4)..(4): Any amino acid
QXLXR

SEQ ID NO: 1108 - protein, 5 aa, Artificial Sequence
  Description of Artificial Sequence: Synthetic peptide
  MOD_RES (2)..(2): Any amino acid
GXGKS

SEQ ID NO: 1109 - protein, 5 aa, Artificial Sequence
  Description of Artificial Sequence: Synthetic peptide
  MOD_RES (2)..(2): Any amino acid
GXGKT

SEQ ID NO: 1110 - protein, 5 aa, Artificial Sequence
  Description of Artificial Sequence: Synthetic peptide
  MOD_RES (2)..(2): Any amino acid
AXKTT

SEQ ID NO: 1111 - protein, 5 aa, Artificial Sequence
  Description of Artificial Sequence: Synthetic peptide
  MOD_RES (2)..(2): Any amino acid
DXAGK

SEQ ID NO: 1112 - protein, 5 aa, Artificial Sequence
  Description of Artificial Sequence: Synthetic peptide
  MOD_RES (2)..(2): Any amino acid
TXVDK

SEQ ID NO: 1113 - protein, 5 aa, Artificial Sequence
  Description of Artificial Sequence: Synthetic peptide
  MOD_RES (2)..(2): Any amino acid
TXTGK

SEQ ID NO: 1114 - protein, 5 aa, Artificial Sequence
  Description of Artificial Sequence: Synthetic peptide
  MOD_RES (2)..(2): Any amino acid
SXKVD

SEQ ID NO: 1115 - protein, 5 aa, Artificial Sequence
  Description of Artificial Sequence: Synthetic peptide
  MOD_RES (2)..(2): Any amino acid
SXVGK

SEQ ID NO: 1116 - protein, 5 aa, Artificial Sequence
  Description of Artificial Sequence: Synthetic peptide
  MOD_RES (2)..(2): Any amino acid
KXDKK

SEQ ID NO: 1117 - protein, 5 aa, Artificial Sequence
  Description of Artificial Sequence: Synthetic peptide
  MOD_RES (2)..(2): Any amino acid
VXCKN

SEQ ID NO: 1118 - protein, 5 aa, Artificial Sequence
  Description of Artificial Sequence: Synthetic peptide
  MOD_RES (2)..(2): Any amino acid
SXKTT

SEQ ID NO: 1119 - protein, 5 aa, Artificial Sequence
  Description of Artificial Sequence: Synthetic peptide
  MOD_RES (2)..(2): Any amino acid
GXTNS

SEQ ID NO: 1120 - protein, 5 aa, Artificial Sequence
  Description of Artificial Sequence: Synthetic peptide
  MOD_RES (2)..(2): Any amino acid
NXACK

SEQ ID NO: 1121 - protein, 5 aa, Artificial Sequence
  Description of Artificial Sequence: Synthetic peptide
  MOD_RES (2)..(2): Any amino acid
SXTKV

SEQ ID NO: 1122 - protein, 5 aa, Artificial Sequence
  Description of Artificial Sequence: Synthetic peptide
  MOD_RES (2)..(2): Any amino acid
AXIGR

SEQ ID NO: 1123 - protein, 5 aa, Artificial Sequence
  Description of Artificial Sequence: Synthetic peptide
  MOD_RES (2)..(2): Any amino acid
NXGKT

SEQ ID NO: 1124 - protein, 5 aa, Artificial Sequence
  Description of Artificial Sequence: Synthetic peptide
  MOD_RES (2)..(2): Any amino acid
SXKST

SEQ ID NO: 1125 - protein, 5 aa, Artificial Sequence
  Description of Artificial Sequence: Synthetic peptide
  MOD_RES (2)..(2): Any amino acid
QXGKT

SEQ ID NO: 1126 - protein, 5 aa, Artificial Sequence
  Description of Artificial Sequence: Synthetic peptide
  MOD_RES (2)..(2): Any amino acid
TXNIG

SEQ ID NO: 1127 - protein, 5 aa, Artificial Sequence
  Description of Artificial Sequence: Synthetic peptide
  MOD_RES (2)..(2): Any amino acid
VXKSS

SEQ ID NO: 1128 - protein, 5 aa, Artificial Sequence
  Description of Artificial Sequence: Synthetic peptide
  MOD_RES (2)..(2): Any amino acid
VXKTS

SEQ ID NO: 1129 - protein, 5 aa, Artificial Sequence
  Description of Artificial Sequence: Synthetic peptide
  MOD_RES (2)..(2): Any amino acid
GXGLG

SEQ ID NO: 1130 - protein, 5 aa, Artificial Sequence
  Description of Artificial Sequence: Synthetic peptide
  MOD_RES (2)..(2): Any amino acid
CXAGI

SEQ ID NO: 1131 - protein, 5 aa, Artificial Sequence
  Description of Artificial Sequence: Synthetic peptide
  MOD_RES (2)..(2): Any amino acid
SXTGN

SEQ ID NO: 1132 - protein, 5 aa, Artificial Sequence
  Description of Artificial Sequence: Synthetic peptide
  MOD_RES (2)..(2): Any amino acid
CXGNI

SEQ ID NO: 1133 - protein, 5 aa, Artificial Sequence
  Description of Artificial Sequence: Synthetic peptide
  MOD_RES (2)..(2): Any amino acid
AXGRT

SEQ ID NO: 1134 - protein, 5 aa, Artificial Sequence
  Description of Artificial Sequence: Synthetic peptide
  MOD_RES (2)..(2): Any amino acid
NXLFV

SEQ ID NO: 1135 - protein, 5 aa, Artificial Sequence
  Description of Artificial Sequence: Synthetic peptide
  MOD_RES (2)..(2): Any amino acid
RXTDV

SEQ ID NO: 1136 - protein, 5 aa, Artificial Sequence
  Description of Artificial Sequence: Synthetic peptide
  MOD_RES (2)..(2): Any amino acid
VXKSA

SEQ ID NO: 1137 - protein, 5 aa, Artificial Sequence
  Description of Artificial Sequence: Synthetic peptide
  MOD_RES (2)..(2): Any amino acid
YXSGR

SEQ ID NO: 1138 - protein, 5 aa, Artificial Sequence
  Description of Artificial Sequence: Synthetic peptide
  MOD_RES (2)..(2): Any amino acid
QXTYS

SEQ ID NO: 1139 - protein, 5 aa, Artificial Sequence
  Description of Artificial Sequence: Synthetic peptide
  MOD_RES (2)..(2): Any amino acid
HXASV

SEQ ID NO: 1140 - protein, 5 aa, Artificial Sequence
  Description of Artificial Sequence: Synthetic peptide
  MOD_RES (2)..(2): Any amino acid
KXVHA

SEQ ID NO: 1141 - protein, 5 aa, Artificial Sequence
  Description of Artificial Sequence: Synthetic peptide
  MOD_RES (2)..(2): Any amino acid
NXPKC

SEQ ID NO: 1142 - protein, 5 aa, Artificial Sequence
  Description of Artificial Sequence: Synthetic peptide
  MOD_RES (2)..(2): Any amino acid
SXNTY

SEQ ID NO: 1143 - protein, 5 aa, Artificial Sequence
  Description of Artificial Sequence: Synthetic peptide
  MOD_RES (2)..(2): Any amino acid
DXRFV

SEQ ID NO: 1144 - protein, 5 aa, Artificial Sequence
  Description of Artificial Sequence: Synthetic peptide
  MOD_RES (2)..(2): Any amino acid
GXRDN

SEQ ID NO: 1145 - protein, 5 aa, Artificial Sequence
  Description of Artificial Sequence: Synthetic peptide
  MOD_RES (2)..(2): Any amino acid
PXYAS

SEQ ID NO: 1146 - protein, 5 aa, Artificial Sequence
  Description of Artificial Sequence: Synthetic peptide
  MOD_RES (2)..(2): Any amino acid
NXKVD

SEQ ID NO: 1147 - protein, 5 aa, Artificial Sequence
  Description of Artificial Sequence: Synthetic peptide
  MOD_RES (2)..(2): Any amino acid
AXIGR

SEQ ID NO: 1148 - protein, 5 aa, Artificial Sequence
  Description of Artificial Sequence: Synthetic peptide
  MOD_RES (2)..(2): Any amino acid
KXVAC

SEQ ID NO: 1149 - protein, 5 aa, Artificial Sequence
  Description of Artificial Sequence: Synthetic peptide
  MOD_RES (2)..(2): Any amino acid
RXSET

SEQ ID NO: 1150 - protein, 5 aa, Artificial Sequence
  Description of Artificial Sequence: Synthetic peptide
  MOD_RES (2)..(2): Any amino acid
PXSGK

SEQ ID NO: 1151 - protein, 5 aa, Artificial Sequence
  Description of Artificial Sequence: Synthetic peptide
  MOD_RES (2)..(2): Any amino acid
QXKEG

SEQ ID NO: 1152 - protein, 5 aa, Artificial Sequence
  Description of Artificial Sequence: Synthetic peptide
  MOD_RES (2)..(2): Any amino acid
QXNTN

SEQ ID NO: 1153 - protein, 5 aa, Artificial Sequence
  Description of Artificial Sequence: Synthetic peptide
  MOD_RES (2)..(2): Any amino acid
CXGDS

SEQ ID NO: 1154 - protein, 5 aa, Artificial Sequence
  Description of Artificial Sequence: Synthetic peptide
  MOD_RES (2)..(2): Any amino acid
GXTDW

SEQ ID NO: 1155 - protein, 5 aa, Artificial Sequence
  Description of Artificial Sequence: Synthetic peptide
  MOD_RES (2)..(2): Any amino acid
LXNIC

SEQ ID NO: 1156 - protein, 5 aa, Artificial Sequence
  Description of Artificial Sequence: Synthetic peptide
  MOD_RES (2)..(2): Any amino acid
MXLCT

SEQ ID NO: 1157 - protein, 5 aa, Artificial Sequence
  Description of Artificial Sequence: Synthetic peptide
  MOD_RES (2)..(2): Any amino acid
GXLAH

SEQ ID NO: 1158 - protein, 5 aa, Artificial Sequence
  Description of Artificial Sequence: Synthetic peptide
  MOD_RES (2)..(2): Any amino acid
PXWNI

SEQ ID NO: 1159 - protein, 5 aa, Artificial Sequence
  Description of Artificial Sequence: Synthetic peptide
  MOD_RES (2)..(2): Any amino acid
TXCGV

SEQ ID NO: 1160 - protein, 5 aa, Artificial Sequence
  Description of Artificial Sequence: Synthetic peptide
  MOD_RES (2)..(2): Any amino acid
MXTFK

SEQ ID NO: 1161 - protein, 5 aa, Artificial Sequence
  Description of Artificial Sequence: Synthetic peptide
  MOD_RES (2)..(2): Any amino acid
TXKTF

SEQ ID NO: 1162 - protein, 5 aa, Artificial Sequence
  Description of Artificial Sequence: Synthetic peptide
  MOD_RES (2)..(2): Any amino acid
AXVGR

SEQ ID NO: 1163 - protein, 5 aa, Artificial Sequence
  Description of Artificial Sequence: Synthetic peptide
  MOD_RES (2)..(2): Any amino acid
GXICR

SEQ ID NO: 1164 - protein, 5 aa, Artificial Sequence
  Description of Artificial Sequence: Synthetic peptide
  MOD_RES (2)..(2): Any amino acid
RXLGR

SEQ ID NO: 1165 - protein, 5 aa, Artificial Sequence
  Description of Artificial Sequence: Synthetic peptide
  MOD_RES (2)..(2): Any amino acid
QXPNR

SEQ ID NO: 1166 - protein, 5 aa, Artificial Sequence
  Description of Artificial Sequence: Synthetic peptide
  MOD_RES (2)..(2): Any amino acid
AXKNG

SEQ ID NO: 1167 - protein, 5 aa, Artificial Sequence
  Description of Artificial Sequence: Synthetic peptide
  MOD_RES (2)..(2): Any amino acid
QXIMS

SEQ ID NO: 1168 - protein, 5 aa, Artificial Sequence
  Description of Artificial Sequence: Synthetic peptide
  MOD_RES (2)..(2): Any amino acid
GXVGK

SEQ ID NO: 1169 - protein, 5 aa, Artificial Sequence
  Description of Artificial Sequence: Synthetic peptide
  MOD_RES (2)..(2): Any amino acid
PXVGK

SEQ ID NO: 1170 - protein, 5 aa, Artificial Sequence
  Description of Artificial Sequence: Synthetic peptide
  MOD_RES (2)..(2): Any amino acid
SXSGK

SEQ ID NO: 1171 - protein, 5 aa, Artificial Sequence
  Description of Artificial Sequence: Synthetic peptide
  MOD_RES (2)..(2): Any amino acid
NXGKS

SEQ ID NO: 1172 - protein, 5 aa, Artificial Sequence
  Description of Artificial Sequence: Synthetic peptide
  MOD_RES (2)..(2): Any amino acid
CXGCH

SEQ ID NO: 1173 - protein, 5 aa, Artificial Sequence
  Description of Artificial Sequence: Synthetic peptide
  MOD_RES (2)..(2): Any amino acid
QXVGK

SEQ ID NO: 1174 - protein, 5 aa, Artificial Sequence
  Description of Artificial Sequence: Synthetic peptide
  MOD_RES (2)..(2): Any amino acid
SXGIG

SEQ ID NO: 1175 - protein, 5 aa, Artificial Sequence
  Description of Artificial Sequence: Synthetic peptide
  MOD_RES (2)..(2): Any amino acid
DXGVG

SEQ ID NO: 1176 - protein, 5 aa, Artificial Sequence
  Description of Artificial Sequence: Synthetic peptide
  MOD_RES (2)..(2): Any amino acid
GXTVE

SEQ ID NO: 1177 - protein, 5 aa, Artificial Sequence
  Description of Artificial Sequence: Synthetic peptide
  MOD_RES (2)..(2): Any amino acid
SXGVG

SEQ ID NO: 1178 - protein, 5 aa, Artificial Sequence
  Description of Artificial Sequence: Synthetic peptide
  MOD_RES (2)..(2): Any amino acid
HXLAV

SEQ ID NO: 1179 - protein, 5 aa, Artificial Sequence
  Description of Artificial Sequence: Synthetic peptide
  MOD_RES (2)..(2): Any amino acid
VXKSN

SEQ ID NO: 1180 - protein, 5 aa, Artificial Sequence
  Description of Artificial Sequence: Synthetic peptide
  MOD_RES (2)..(2): Any amino acid
TXAGK

SEQ ID NO: 1181 - protein, 5 aa, Artificial Sequence
  Description of Artificial Sequence: Synthetic peptide
  MOD_RES (2)..(2): Any amino acid
DXGKT

SEQ ID NO: 1182 - protein, 5 aa, Artificial Sequence
  Description of Artificial Sequence: Synthetic peptide
  MOD_RES (2)..(2): Any amino acid
NXGYH

SEQ ID NO: 1183 - protein, 5 aa, Artificial Sequence
  Description of Artificial Sequence: Synthetic peptide
  MOD_RES (2)..(2): Any amino acid
PXGPP

SEQ ID NO: 1184 - protein, 5 aa, Artificial Sequence
  Description of Artificial Sequence: Synthetic peptide
  MOD_RES (2)..(2): Any amino acid
CXSCW

SEQ ID NO: 1185 - protein, 5 aa, Artificial Sequence
  Description of Artificial Sequence: Synthetic peptide
  MOD_RES (2)..(2): Any amino acid
RXRPF

SEQ ID NO: 1186 - protein, 5 aa, Artificial Sequence
  Description of Artificial Sequence: Synthetic peptide
  MOD_RES (2)..(2): Any amino acid
NXTPN

SEQ ID NO: 1187 - protein, 5 aa, Artificial Sequence
  Description of Artificial Sequence: Synthetic peptide
  MOD_RES (2)..(2): Any amino acid
QXSGK

SEQ ID NO: 1188 - protein, 5 aa, Artificial Sequence
  Description of Artificial Sequence: Synthetic peptide
  MOD_RES (2)..(2): Any amino acid
TXKFY

SEQ ID NO: 1189 - protein, 5 aa, Artificial Sequence
  Description of Artificial Sequence: Synthetic peptide
  MOD_RES (2)..(2): Any amino acid
SXGNT

SEQ ID NO: 1190 - protein, 5 aa, Artificial Sequence
  Description of Artificial Sequence: Synthetic peptide
  MOD_RES (2)..(2): Any amino acid
CXSCW

SEQ ID NO: 1191 - protein, 5 aa, Artificial Sequence
  Description of Artificial Sequence: Synthetic peptide
  MOD_RES (2)..(2): Any amino acid
TXKTT

SEQ ID NO: 1192 - protein, 5 aa, Artificial Sequence
  Description of Artificial Sequence: Synthetic peptide
  MOD_RES (2)..(2): Any amino acid
NXGLG

SEQ ID NO: 1193 - protein, 5 aa, Artificial Sequence
  Description of Artificial Sequence: Synthetic peptide
  MOD_RES (2)..(2): Any amino acid
YXTMS

SEQ ID NO: 1194 - protein, 5 aa, Artificial Sequence
  Description of Artificial Sequence: Synthetic peptide
  MOD_RES (2)..(2): Any amino acid
FXRIL

SEQ ID NO: 1195 - protein, 5 aa, Artificial Sequence
  Description of Artificial Sequence: Synthetic peptide
  MOD_RES (2)..(2): Any amino acid
QXGSC

SEQ ID NO: 1196 - protein, 5 aa, Artificial Sequence
  Description of Artificial Sequence: Synthetic peptide
  MOD_RES (2)..(2): Any amino acid
IXNYT

SEQ ID NO: 1197 - protein, 5 aa, Artificial Sequence
  Description of Artificial Sequence: Synthetic peptide
  MOD_RES (2)..(2): Any amino acid
KXVNT

SEQ ID NO: 1198 - protein, 5 aa, Artificial Sequence
  Description of Artificial Sequence: Synthetic peptide
  MOD_RES (2)..(2): Any amino acid
PXMNR

SEQ ID NO: 1199 - protein, 5 aa, Artificial Sequence
  Description of Artificial Sequence: Synthetic peptide
  MOD_RES (2)..(2): Any amino acid
FXYSQ

SEQ ID NO: 1200 - protein, 5 aa, Artificial Sequence
  Description of Artificial Sequence: Synthetic peptide
  MOD_RES (2)..(2): Any amino acid
LXVGM

SEQ ID NO: 1201 - protein, 5 aa, Artificial Sequence
  Description of Artificial Sequence: Synthetic peptide
  MOD_RES (2)..(2): Any amino acid
AXGKT

SEQ ID NO: 1202 - protein, 5 aa, Artificial Sequence
  Description of Artificial Sequence: Synthetic peptide
  MOD_RES (2)..(2): Any amino acid
GXTGK

SEQ ID NO: 1203 - protein, 5 aa, Artificial Sequence
  Description of Artificial Sequence: Synthetic peptide
  MOD_RES (2)..(2): Any amino acid
KXNNY

SEQ ID NO: 1204 - protein, 5 aa, Artificial Sequence
  Description of Artificial Sequence: Synthetic peptide
  MOD_RES (2)..(2): Any amino acid
YXHFC

SEQ ID NO: 1205 - protein, 5 aa, Artificial Sequence
  Description of Artificial Sequence: Synthetic peptide
  MOD_RES (2)..(2): Any amino acid
QXQCG

SEQ ID NO: 1206 - protein, 5 aa, Artificial Sequence
  Description of Artificial Sequence: Synthetic peptide
  MOD_RES (2)..(2): Any amino acid
QXRGY

SEQ ID NO: 1207 - protein, 5 aa, Artificial Sequence
  Description of Artificial Sequence: Synthetic peptide
  MOD_RES (3)..(4): Any amino acid
SGXXT

SEQ ID NO: 1208 - protein, 5 aa, Artificial Sequence
  Description of Artificial Sequence: Synthetic peptide
  MOD_RES (3)..(4): Any amino acid
YHXXN

SEQ ID NO: 1209 - protein, 5 aa, Artificial Sequence
  Description of Artificial Sequence: Synthetic peptide
  MOD_RES (3)..(4): Any amino acid
NKXXL

SEQ ID NO: 1210 - protein, 5 aa, Artificial Sequence
  Description of Artificial Sequence: Synthetic peptide
  MOD_RES (3)..(4): Any amino acid
AGXXT

SEQ ID NO: 1211 - protein, 5 aa, Artificial Sequence
  Description of Artificial Sequence: Synthetic peptide
  MOD_RES (3)..(4): Any amino acid
HEXXH

SEQ ID NO: 1212 - protein, 5 aa, Artificial Sequence
  Description of Artificial Sequence: Synthetic peptide
  MOD_RES (3)..(4): Any amino acid
ACXXG

SEQ ID NO: 1213 - protein, 5 aa, Artificial Sequence
  Description of Artificial Sequence: Synthetic peptide
  MOD_RES (3)..(4): Any amino acid
VIXXW

SEQ ID NO: 1214 - protein, 5 aa, Artificial Sequence
  Description of Artificial Sequence: Synthetic peptide
  MOD_RES (3)..(4): Any amino acid
TGXXK

SEQ ID NO: 1215 - protein, 5 aa, Artificial Sequence
  Description of Artificial Sequence: Synthetic peptide
  MOD_RES (3)..(4): Any amino acid
GVXXS

SEQ ID NO: 1216 - protein, 5 aa, Artificial Sequence
  Description of Artificial Sequence: Synthetic peptide
  MOD_RES (3)..(4): Any amino acid
QDXXG

SEQ ID NO: 1217 - protein, 5 aa, Artificial Sequence
  Description of Artificial Sequence: Synthetic peptide
  MOD_RES (3)..(4): Any amino acid
EEXXR

SEQ ID NO: 1218 - protein, 5 aa, Artificial Sequence
  Description of Artificial Sequence: Synthetic peptide
  MOD_RES (3)..(4): Any amino acid
NFXXL

SEQ ID NO: 1219 - protein, 5 aa, Artificial Sequence
  Description of Artificial Sequence: Synthetic peptide
  MOD_RES (3)..(4): Any amino acid
VGXXS

SEQ ID NO: 1220 - protein, 5 aa, Artificial Sequence
  Description of Artificial Sequence: Synthetic peptide
  MOD_RES (3)..(4): Any amino acid
LSXXE

SEQ ID NO: 1221 - protein, 5 aa, Artificial Sequence
  Description of Artificial Sequence: Synthetic peptide
  MOD_RES (3)..(4): Any amino acid
FPXXL

SEQ ID NO: 1222 - protein, 5 aa, Artificial Sequence
  Description of Artificial Sequence: Synthetic peptide
  MOD_RES (3)..(4): Any amino acid
GFXXS

SEQ ID NO: 1223 - protein, 5 aa, Artificial Sequence
  Description of Artificial Sequence: Synthetic peptide
  MOD_RES (3)..(4): Any amino acid
SGXXK

SEQ ID NO: 1224 - protein, 5 aa, Artificial Sequence
  Description of Artificial Sequence: Synthetic peptide
  MOD_RES (3)..(4): Any amino acid
EAXXA

SEQ ID NO: 1225 - protein, 5 aa, Artificial Sequence
  Description of Artificial Sequence: Synthetic peptide
  MOD_RES (3)..(4): Any amino acid
RRXXE

SEQ ID NO: 1226 - protein, 5 aa, Artificial Sequence
  Description of Artificial Sequence: Synthetic peptide
  MOD_RES (3)..(4): Any amino acid
LSXXY

SEQ ID NO: 1227 - protein, 5 aa, Artificial Sequence
  Description of Artificial Sequence: Synthetic peptide
  MOD_RES (3)..(4): Any amino acid
GLXXW

SEQ ID NO: 1228 - protein, 5 aa, Artificial Sequence
  Description of Artificial Sequence: Synthetic peptide
  MOD_RES (3)..(4): Any amino acid
TKXXK

SEQ ID NO: 1229 - protein, 5 aa, Artificial Sequence
  Description of Artificial Sequence: Synthetic peptide
  MOD_RES (3)..(4): Any amino acid
DEXXR

SEQ ID NO: 1230 - protein, 5 aa, Artificial Sequence
  Description of Artificial Sequence: Synthetic peptide
  MOD_RES (3)..(4): Any amino acid
AAXXA

SEQ ID NO: 1231 - protein, 5 aa, Artificial Sequence
  Description of Artificial Sequence: Synthetic peptide
  MOD_RES (3)..(4): Any amino acid
MNXXE

SEQ ID NO: 1232 - protein, 5 aa, Artificial Sequence
  Description of Artificial Sequence: Synthetic peptide
  MOD_RES (3)..(4): Any amino acid
EGXXY

SEQ ID NO: 1233 - protein, 5 aa, Artificial Sequence
  Description of Artificial Sequence: Synthetic peptide
  MOD_RES (3)..(4): Any amino acid
LTXXE

SEQ ID NO: 1234 - protein, 5 aa, Artificial Sequence
  Description of Artificial Sequence: Synthetic peptide
  MOD_RES (3)..(4): Any amino acid
SKXXH

SEQ ID NO: 1235 - protein, 5 aa, Artificial Sequence
  Description of Artificial Sequence: Synthetic peptide
  MOD_RES (3)..(4): Any amino acid
EEXXA

SEQ ID NO: 1236 - protein, 5 aa, Artificial Sequence
  Description of Artificial Sequence: Synthetic peptide
  MOD_RES (3)..(4): Any amino acid
STXXD

SEQ ID NO: 1237 - protein, 5 aa, Artificial Sequence
  Description of Artificial Sequence: Synthetic peptide
  MOD_RES (3)..(4): Any amino acid
VSXXE

SEQ ID NO: 1238 - protein, 5 aa, Artificial Sequence
  Description of Artificial Sequence: Synthetic peptide
  MOD_RES (3)..(4): Any amino acid
ARXXA

SEQ ID NO: 1239 - protein, 5 aa, Artificial Sequence
  Description of Artificial Sequence: Synthetic peptide
  MOD_RES (3)..(4): Any amino acid
NYXXQ

SEQ ID NO: 1240 - protein, 5 aa, Artificial Sequence
  Description of Artificial Sequence: Synthetic peptide
  MOD_RES (3)..(4): Any amino acid
AAXXG

SEQ ID NO: 1241 - protein, 5 aa, Artificial Sequence
  Description of Artificial Sequence: Synthetic peptide
  MOD_RES (3)..(4): Any amino acid
PTXXI

SEQ ID NO: 1242 - protein, 5 aa, Artificial Sequence
  Description of Artificial Sequence: Synthetic peptide
  MOD_RES (3)..(4): Any amino acid
AAXXR

SEQ ID NO: 1243 - protein, 5 aa, Artificial Sequence
  Description of Artificial Sequence: Synthetic peptide
  MOD_RES (3)..(4): Any amino acid
GTXXT

SEQ ID NO: 1244 - protein, 5 aa, Artificial Sequence
  Description of Artificial Sequence: Synthetic peptide
  MOD_RES (3)..(4): Any amino acid
VVXXR

SEQ ID NO: 1245 - protein, 5 aa, Artificial Sequence
  Description of Artificial Sequence: Synthetic peptide
  MOD_RES (3)..(4): Any amino acid
QQXXY

SEQ ID NO: 1246 - protein, 5 aa, Artificial Sequence
  Description of Artificial Sequence: Synthetic peptide
  MOD_RES (3)..(4): Any amino acid
TQXXK

SEQ ID NO: 1247 - protein, 5 aa, Artificial Sequence
  Description of Artificial Sequence: Synthetic peptide
  MOD_RES (3)..(4): Any amino acid
AAXXQ

SEQ ID NO: 1248 - protein, 5 aa, Artificial Sequence
  Description of Artificial Sequence: Synthetic peptide
  MOD_RES (3)..(4): Any amino acid
ERXXM

SEQ ID NO: 1249 - protein, 5 aa, Artificial Sequence
  Description of Artificial Sequence: Synthetic peptide
  MOD_RES (3)..(4): Any amino acid
LSXXQ

SEQ ID NO: 1250 - protein, 5 aa, Artificial Sequence
  Description of Artificial Sequence: Synthetic peptide
  MOD_RES (3)..(4): Any amino acid
AEXXR

SEQ ID NO: 1251 - protein, 5 aa, Artificial Sequence
  Description of Artificial Sequence: Synthetic peptide
  MOD_RES (3)..(4): Any amino acid
PEXXR

SEQ ID NO: 1252 - protein, 5 aa, Artificial Sequence
  Description of Artificial Sequence: Synthetic peptide
  MOD_RES (3)..(4): Any amino acid
REXXL

SEQ ID NO: 1253 - protein, 5 aa, Artificial Sequence
  Description of Artificial Sequence: Synthetic peptide
  MOD_RES (3)..(4): Any amino acid
VAXXN

SEQ ID NO: 1254 - protein, 5 aa, Artificial Sequence
  Description of Artificial Sequence: Synthetic peptide
  MOD_RES (3)..(4): Any amino acid
NEXXR

SEQ ID NO: 1255 - protein, 5 aa, Artificial Sequence
  Description of Artificial Sequence: Synthetic peptide
  MOD_RES (3)..(4): Any amino acid
REXXR

SEQ ID NO: 1256 - protein, 5 aa, Artificial Sequence
  Description of Artificial Sequence: Synthetic peptide
  MOD_RES (3)..(4): Any amino acid
SAXXG

SEQ ID NO: 1257 - protein, 5 aa, Artificial Sequence
  Description of Artificial Sequence: Synthetic peptide
  MOD_RES (3)..(4): Any amino acid
QFXXN

SEQ ID NO: 1258 - protein, 5 aa, Artificial Sequence
  Description of Artificial Sequence: Synthetic peptide
  MOD_RES (3)..(4): Any amino acid
GHXXL

SEQ ID NO: 1259 - protein, 5 aa, Artificial Sequence
  Description of Artificial Sequence: Synthetic peptide
  MOD_RES (3)..(4): Any amino acid
ISXXT

SEQ ID NO: 1260 - protein, 5 aa, Artificial Sequence
  Description of Artificial Sequence: Synthetic peptide
  MOD_RES (3)..(4): Any amino acid
PVXXA

SEQ ID NO: 1261 - protein, 5 aa, Artificial Sequence
  Description of Artificial Sequence: Synthetic peptide
  MOD_RES (3)..(4): Any amino acid
PGXXE

SEQ ID NO: 1262 - protein, 5 aa, Artificial Sequence
  Description of Artificial Sequence: Synthetic peptide
  MOD_RES (3)..(4): Any amino acid
ASXXT

SEQ ID NO: 1263 - protein, 5 aa, Artificial Sequence
  Description of Artificial Sequence: Synthetic peptide
  MOD_RES (3)..(4): Any amino acid
KNXXC

SEQ ID NO: 1264 - protein, 5 aa, Artificial Sequence
  Description of Artificial Sequence: Synthetic peptide
  MOD_RES (3)..(4): Any amino acid
CQXXS

SEQ ID NO: 1265 - protein, 5 aa, Artificial Sequence
  Description of Artificial Sequence: Synthetic peptide
  MOD_RES (3)..(4): Any amino acid
QTXXR

SEQ ID NO: 1266 - protein, 5 aa, Artificial Sequence
  Description of Artificial Sequence: Synthetic peptide
  MOD_RES (3)..(4): Any amino acid
NQXXN

SEQ ID NO: 1267 - protein, 5 aa, Artificial Sequence
  Description of Artificial Sequence: Synthetic peptide
  MOD_RES (3)..(4): Any amino acid
FRXXD

SEQ ID NO: 1268 - protein, 5 aa, Artificial Sequence
  Description of Artificial Sequence: Synthetic peptide
  MOD_RES (3)..(4): Any amino acid
AAXXE

SEQ ID NO: 1269 - protein, 5 aa, Artificial Sequence
  Description of Artificial Sequence: Synthetic peptide
  MOD_RES (3)..(4): Any amino acid
PEXXA

SEQ ID NO: 1270 - protein, 5 aa, Artificial Sequence
  Description of Artificial Sequence: Synthetic peptide
  MOD_RES (3)..(4): Any amino acid
REXXA

SEQ ID NO: 1271 - protein, 5 aa, Artificial Sequence
  Description of Artificial Sequence: Synthetic peptide
  MOD_RES (3)..(4): Any amino acid
QTXXT

SEQ ID NO: 1272 - protein, 5 aa, Artificial Sequence
  Description of Artificial Sequence: Synthetic peptide
  MOD_RES (3)..(4): Any amino acid
PEXXN

SEQ ID NO: 1273 - protein, 5 aa, Artificial Sequence
  Description of Artificial Sequence: Synthetic peptide
  MOD_RES (3)..(4): Any amino acid
PGXXA

SEQ ID NO: 1274 - protein, 5 aa, Artificial Sequence
  Description of Artificial Sequence: Synthetic peptide
  MOD_RES (3)..(4): Any amino acid
AQXXS

SEQ ID NO: 1275 - protein, 5 aa, Artificial Sequence
  Description of Artificial Sequence: Synthetic peptide
  MOD_RES (3)..(4): Any amino acid
AEXXQ

SEQ ID NO: 1276 - protein, 5 aa, Artificial Sequence
  Description of Artificial Sequence: Synthetic peptide
  MOD_RES (3)..(4): Any amino acid
EDXXY

SEQ ID NO: 1277 - protein, 5 aa, Artificial Sequence
  Description of Artificial Sequence: Synthetic peptide
  MOD_RES (3)..(4): Any amino acid
LPXXV

SEQ ID NO: 1278 - protein, 5 aa, Artificial Sequence
  Description of Artificial Sequence: Synthetic peptide
  MOD_RES (3)..(4): Any amino acid
GSXXT

SEQ ID NO: 1279 - protein, 5 aa, Artificial Sequence
  Description of Artificial Sequence: Synthetic peptide
  MOD_RES (3)..(4): Any amino acid
GGXXK

SEQ ID NO: 1280 - protein, 5 aa, Artificial Sequence
  Description of Artificial Sequence: Synthetic peptide
  MOD_RES (3)..(4): Any amino acid
QAXXD

SEQ ID NO: 1281 - protein, 5 aa, Artificial Sequence
  Description of Artificial Sequence: Synthetic peptide
  MOD_RES (3)..(4): Any amino acid
MNXXD

SEQ ID NO: 1282 - protein, 5 aa, Artificial Sequence
  Description of Artificial Sequence: Synthetic peptide
  MOD_RES (3)..(4): Any amino acid
AEXXA

SEQ ID NO: 1283 - protein, 5 aa, Artificial Sequence
  Description of Artificial Sequence: Synthetic peptide
  MOD_RES (3)..(4): Any amino acid
CGXXW

SEQ ID NO: 1284 - protein, 5 aa, Artificial Sequence
  Description of Artificial Sequence: Synthetic peptide
  MOD_RES (3)..(4): Any amino acid
AEXXS

SEQ ID NO: 1285 - protein, 5 aa, Artificial Sequence
  Description of Artificial Sequence: Synthetic peptide
  MOD_RES (3)..(4): Any amino acid
LAXXE

SEQ ID NO: 1286 - protein, 5 aa, Artificial Sequence
  Description of Artificial Sequence: Synthetic peptide
  MOD_RES (3)..(4): Any amino acid
YQXXL

SEQ ID NO: 1287 - protein, 5 aa, Artificial Sequence
  Description of Artificial Sequence: Synthetic peptide
  MOD_RES (3)..(4): Any amino acid
GSXXS

SEQ ID NO: 1288 - protein, 5 aa, Artificial Sequence
  Description of Artificial Sequence: Synthetic peptide
  MOD_RES (3)..(4): Any amino acid
RSXXE

SEQ ID NO: 1289 - protein, 5 aa, Artificial Sequence
  Description of Artificial Sequence: Synthetic peptide
  MOD_RES (3)..(4): Any amino acid
PEXXT

SEQ ID NO: 1290 - protein, 5 aa, Artificial Sequence
  Description of Artificial Sequence: Synthetic peptide
  MOD_RES (3)..(4): Any amino acid
RIXXN

SEQ ID NO: 1291 - protein, 5 aa, Artificial Sequence
  Description of Artificial Sequence: Synthetic peptide
  MOD_RES (3)..(4): Any amino acid
ALXXE

SEQ ID NO: 1292 - protein, 5 aa, Artificial Sequence
  Description of Artificial Sequence: Synthetic peptide
  MOD_RES (3)..(4): Any amino acid
STXXR

SEQ ID NO: 1293 - protein, 5 aa, Artificial Sequence
  Description of Artificial Sequence: Synthetic peptide
  MOD_RES (3)..(4): Any amino acid
SWXXG

SEQ ID NO: 1294 - protein, 5 aa, Artificial Sequence
  Description of Artificial Sequence: Synthetic peptide
  MOD_RES (3)..(4): Any amino acid
LGXXI

SEQ ID NO: 1295 - protein, 5 aa, Artificial Sequence
  Description of Artificial Sequence: Synthetic peptide
  MOD_RES (3)..(4): Any amino acid
NVXXK

SEQ ID NO: 1296 - protein, 5 aa, Artificial Sequence
  Description of Artificial Sequence: Synthetic peptide
  MOD_RES (3)..(4): Any amino acid
PAXXA

SEQ ID NO: 1297 - protein, 5 aa, Artificial Sequence
  Description of Artificial Sequence: Synthetic peptide
  MOD_RES (3)..(4): Any amino acid
DAXXA

SEQ ID NO: 1298 - protein, 5 aa, Artificial Sequence
  Description of Artificial Sequence: Synthetic peptide
  MOD_RES (3)..(4): Any amino acid
WGXXC

SEQ ID NO: 1299 - protein, 5 aa, Artificial Sequence
  Description of Artificial Sequence: Synthetic peptide
  MOD_RES (3)..(4): Any amino acid
ISXXE

SEQ ID NO: 1300 - protein, 5 aa, Artificial Sequence
  Description of Artificial Sequence: Synthetic peptide
  MOD_RES (3)..(4): Any amino acid
RRXXA

SEQ ID NO: 1301 - protein, 5 aa, Artificial Sequence
  Description of Artificial Sequence: Synthetic peptide
  MOD_RES (3)..(4): Any amino acid
EQXXA

SEQ ID NO: 1302 - protein, 5 aa, Artificial Sequence
  Description of Artificial Sequence: Synthetic peptide
  MOD_RES (3)..(4): Any amino acid
HGXXT

SEQ ID NO: 1303 - protein, 5 aa, Artificial Sequence
  Description of Artificial Sequence: Synthetic peptide
  MOD_RES (3)..(4): Any amino acid
ANXXN

SEQ ID NO: 1304 - protein, 5 aa, Artificial Sequence
  Description of Artificial Sequence: Synthetic peptide
  MOD_RES (3)..(4): Any amino acid
ARXXQ

SEQ ID NO: 1305 - protein, 5 aa, Artificial Sequence
  Description of Artificial Sequence: Synthetic peptide
  MOD_RES (3)..(4): Any amino acid
AQXXA

SEQ ID NO: 1306 - protein, 5 aa, Artificial Sequence
  Description of Artificial Sequence: Synthetic peptide
  MOD_RES (3)..(3): Any amino acid
NKXDL

SEQ ID NO: 1307 - protein, 5 aa, Artificial Sequence
  Description of Artificial Sequence: Synthetic peptide
  MOD_RES (3)..(3): Any amino acid
AGXTT

SEQ ID NO: 1308 - protein, 5 aa, Artificial Sequence
  Description of Artificial Sequence: Synthetic peptide
  MOD_RES (3)..(3): Any amino acid
TKXDK

SEQ ID NO: 1309 - protein, 5 aa, Artificial Sequence
  Description of Artificial Sequence: Synthetic peptide
  MOD_RES (3)..(3): Any amino acid
GVXKS

SEQ ID NO: 1310 - protein, 5 aa, Artificial Sequence
  Description of Artificial Sequence: Synthetic peptide
  MOD_RES (3)..(3): Any amino acid
STXVD

SEQ ID NO: 1311 - protein, 5 aa, Artificial Sequence
  Description of Artificial Sequence: Synthetic peptide
  MOD_RES (3)..(3): Any amino acid
GFXNS

SEQ ID NO: 1312 - protein, 5 aa, Artificial Sequence
  Description of Artificial Sequence: Synthetic peptide
  MOD_RES (3)..(3): Any amino acid
TGXGK

SEQ ID NO: 1313 - protein, 5 aa, Artificial Sequence
  Description of Artificial Sequence: Synthetic peptide
  MOD_RES (3)..(3): Any amino acid
SGXGK

SEQ ID NO: 1314 - protein, 5 aa, Artificial Sequence
  Description of Artificial Sequence: Synthetic peptide
  MOD_RES (3)..(3): Any amino acid
KVXKK

SEQ ID NO: 1315 - protein, 5 aa, Artificial Sequence
  Description of Artificial Sequence: Synthetic peptide
  MOD_RES (3)..(3): Any amino acid
NVXCK

SEQ ID NO: 1316 - protein, 5 aa, Artificial Sequence
  Description of Artificial Sequence: Synthetic peptide
  MOD_RES (3)..(3): Any amino acid
TQXGK

SEQ ID NO: 1317 - protein, 5 aa, Artificial Sequence
  Description of Artificial Sequence: Synthetic peptide
  MOD_RES (3)..(3): Any amino acid
VGXSS

SEQ ID NO: 1318 - protein, 5 aa, Artificial Sequence
  Description of Artificial Sequence: Synthetic peptide
  MOD_RES (3)..(3): Any amino acid
AGXGR

SEQ ID NO: 1319 - protein, 5 aa, Artificial Sequence
  Description of Artificial Sequence: Synthetic peptide
  MOD_RES (3)..(3): Any amino acid
QTXKT

SEQ ID NO: 1320 - protein, 5 aa, Artificial Sequence
  Description of Artificial Sequence: Synthetic peptide
  MOD_RES (3)..(3): Any amino acid
CGXCW

SEQ ID NO: 1321 - protein, 5 aa, Artificial Sequence
  Description of Artificial Sequence: Synthetic peptide
  MOD_RES (3)..(3): Any amino acid
ACXNG

SEQ ID NO: 1322 - protein, 5 aa, Artificial Sequence
  Description of Artificial Sequence: Synthetic peptide
  MOD_RES (3)..(3): Any amino acid
CSXGI

SEQ ID NO: 1323 - protein, 5 aa, Artificial Sequence
  Description of Artificial Sequence: Synthetic peptide
  MOD_RES (3)..(3): Any amino acid
GSXKS

SEQ ID NO: 1324 - protein, 5 aa, Artificial Sequence
  Description of Artificial Sequence: Synthetic peptide
  MOD_RES (3)..(3): Any amino acid
SGXST

SEQ ID NO: 1325 - protein, 5 aa, Artificial Sequence
  Description of Artificial Sequence: Synthetic peptide
  MOD_RES (3)..(3): Any amino acid
SGXTT

SEQ ID NO: 1326 - protein, 5 aa, Artificial Sequence
  Description of Artificial Sequence: Synthetic peptide
  MOD_RES (3)..(3): Any amino acid
TWXIG

SEQ ID NO: 1327 - protein, 5 aa, Artificial Sequence
  Description of Artificial Sequence: Synthetic peptide
  MOD_RES (3)..(3): Any amino acid
GTXKT

SEQ ID NO: 1328 - protein, 5 aa, Artificial Sequence
  Description of Artificial Sequence: Synthetic peptide
  MOD_RES (3)..(3): Any amino acid
YAXGR

SEQ ID NO: 1329 - protein, 5 aa, Artificial Sequence
  Description of Artificial Sequence: Synthetic peptide
  MOD_RES (3)..(3): Any amino acid
LGXSI

SEQ ID NO: 1330 - protein, 5 aa, Artificial Sequence
  Description of Artificial Sequence: Synthetic peptide
  MOD_RES (3)..(3): Any amino acid
SPXSL

SEQ ID NO: 1331 - protein, 5 aa, Artificial Sequence
  Description of Artificial Sequence: Synthetic peptide
  MOD_RES (3)..(3): Any amino acid
VGXTS

SEQ ID NO: 1332 - protein, 5 aa, Artificial Sequence
  Description of Artificial Sequence: Synthetic peptide
  MOD_RES (3)..(3): Any amino acid
QFXTN

SEQ ID NO: 1333 - protein, 5 aa, Artificial Sequence
  Description of Artificial Sequence: Synthetic peptide
  MOD_RES (3)..(3): Any amino acid
GTXVV

SEQ ID NO: 1334 - protein, 5 aa, Artificial Sequence
  Description of Artificial Sequence: Synthetic peptide
  MOD_RES (3)..(3): Any amino acid
SAXIG

SEQ ID NO: 1335 - protein, 5 aa, Artificial Sequence
  Description of Artificial Sequence: Synthetic peptide
  MOD_RES (3)..(3): Any amino acid
GLXDW

SEQ ID NO: 1336 - protein, 5 aa, Artificial Sequence
  Description of Artificial Sequence: Synthetic peptide
  MOD_RES (3)..(3): Any amino acid
QQXDY

SEQ ID NO: 1337 - protein, 5 aa, Artificial Sequence
  Description of Artificial Sequence: Synthetic peptide
  MOD_RES (3)..(3): Any amino acid
VVXGK

SEQ ID NO: 1338 - protein, 5 aa, Artificial Sequence
  Description of Artificial Sequence: Synthetic peptide
  MOD_RES (3)..(3): Any amino acid
QSXGA

SEQ ID NO: 1339 - protein, 5 aa, Artificial Sequence
  Description of Artificial Sequence: Synthetic peptide
  MOD_RES (3)..(3): Any amino acid
HEXEN

SEQ ID NO: 1340 - protein, 5 aa, Artificial Sequence
  Description of Artificial Sequence: Synthetic peptide
  MOD_RES (3)..(3): Any amino acid
FAXKL

SEQ ID NO: 1341 - protein, 5 aa, Artificial Sequence
  Description of Artificial Sequence: Synthetic peptide
  MOD_RES (3)..(3): Any amino acid
ASXNT

SEQ ID NO: 1342 - protein, 5 aa, Artificial Sequence
  Description of Artificial Sequence: Synthetic peptide
  MOD_RES (3)..(3): Any amino acid
DMXIT

SEQ ID NO: 1343 - protein, 5 aa, Artificial Sequence
  Description of Artificial Sequence: Synthetic peptide
  MOD_RES (3)..(3): Any amino acid
YIXIH

SEQ ID NO: 1344 - protein, 5 aa, Artificial Sequence
  Description of Artificial Sequence: Synthetic peptide
  MOD_RES (3)..(3): Any amino acid
TQXHG

SEQ ID NO: 1345 - protein, 5 aa, Artificial Sequence
  Description of Artificial Sequence: Synthetic peptide
  MOD_RES (3)..(3): Any amino acid
GYXDN

SEQ ID NO: 1346 - protein, 5 aa, Artificial Sequence
  Description of Artificial Sequence: Synthetic peptide
  MOD_RES (3)..(3): Any amino acid
QDXEG

SEQ ID NO: 1347 - protein, 5 aa, Artificial Sequence
  Description of Artificial Sequence: Synthetic peptide
  MOD_RES (3)..(3): Any amino acid
DNXGK

SEQ ID NO: 1348 - protein, 5 aa, Artificial Sequence
  Description of Artificial Sequence: Synthetic peptide
  MOD_RES (3)..(3): Any amino acid
SAXVG

SEQ ID NO: 1349 - protein, 5 aa, Artificial Sequence
  Description of Artificial Sequence: Synthetic peptide
  MOD_RES (3)..(3): Any amino acid
ASXRT

SEQ ID NO: 1350 - protein, 5 aa, Artificial Sequence
  Description of Artificial Sequence: Synthetic peptide
  MOD_RES (3)..(3): Any amino acid
SSXKV

SEQ ID NO: 1351 - protein, 5 aa, Artificial Sequence
  Description of Artificial Sequence: Synthetic peptide
  MOD_RES (3)..(3): Any amino acid
GSXKT

SEQ ID NO: 1352 - protein, 5 aa, Artificial Sequence
  Description of Artificial Sequence: Synthetic peptide
  MOD_RES (3)..(3): Any amino acid
PTXNI

SEQ ID NO: 1353 - protein, 5 aa, Artificial Sequence
  Description of Artificial Sequence: Synthetic peptide
  MOD_RES (3)..(3): Any amino acid
GNXCR

SEQ ID NO: 1354 - protein, 5 aa, Artificial Sequence
  Description of Artificial Sequence: Synthetic peptide
  MOD_RES (3)..(3): Any amino acid
PNXGK

SEQ ID NO: 1355 - protein, 5 aa, Artificial Sequence
  Description of Artificial Sequence: Synthetic peptide
  MOD_RES (3)..(3): Any amino acid
GAXKT

SEQ ID NO: 1356 - protein, 5 aa, Artificial Sequence
  Description of Artificial Sequence: Synthetic peptide
  MOD_RES (3)..(3): Any amino acid
KNXAC

SEQ ID NO: 1357 - protein, 5 aa, Artificial Sequence
  Description of Artificial Sequence: Synthetic peptide
  MOD_RES (3)..(3): Any amino acid
QTXNR

SEQ ID NO: 1358 - protein, 5 aa, Artificial Sequence
  Description of Artificial Sequence: Synthetic peptide
  MOD_RES (3)..(3): Any amino acid
WGXGC

SEQ ID NO: 1359 - protein, 5 aa, Artificial Sequence
  Description of Artificial Sequence: Synthetic peptide
  MOD_RES (3)..(3): Any amino acid
NAXKT

SEQ ID NO: 1360 - protein, 5 aa, Artificial Sequence
  Description of Artificial Sequence: Synthetic peptide
  MOD_RES (3)..(3): Any amino acid
CLXNI

SEQ ID NO: 1361 - protein, 5 aa, Artificial Sequence
  Description of Artificial Sequence: Synthetic peptide
  MOD_RES (3)..(3): Any amino acid
AAXKT

SEQ ID NO: 1362 - protein, 5 aa, Artificial Sequence
  Description of Artificial Sequence: Synthetic peptide
  MOD_RES (3)..(3): Any amino acid
NTXVD

SEQ ID NO: 1363 - protein, 5 aa, Artificial Sequence
  Description of Artificial Sequence: Synthetic peptide
  MOD_RES (3)..(3): Any amino acid
VGXSA

SEQ ID NO: 1364 - protein, 5 aa, Artificial Sequence
  Description of Artificial Sequence: Synthetic peptide
  MOD_RES (3)..(3): Any amino acid
MEXCT

SEQ ID NO: 1365 - protein, 5 aa, Artificial Sequence
  Description of Artificial Sequence: Synthetic peptide
  MOD_RES (3)..(3): Any amino acid
RMXTF

SEQ ID NO: 1366 - protein, 5 aa, Artificial Sequence
  Description of Artificial Sequence: Synthetic peptide
  MOD_RES (3)..(3): Any amino acid
QGXMS

SEQ ID NO: 1367 - protein, 5 aa, Artificial Sequence
  Description of Artificial Sequence: Synthetic peptide
  MOD_RES (3)..(3): Any amino acid
VAXKN

SEQ ID NO: 1368 - protein, 5 aa, Artificial Sequence
  Description of Artificial Sequence: Synthetic peptide
  MOD_RES (3)..(3): Any amino acid
GGXGK

SEQ ID NO: 1369 - protein, 5 aa, Artificial Sequence
  Description of Artificial Sequence: Synthetic peptide
  MOD_RES (3)..(3): Any amino acid
AGXGR

SEQ ID NO: 1370 - protein, 5 aa, Artificial Sequence
  Description of Artificial Sequence: Synthetic peptide
  MOD_RES (3)..(3): Any amino acid
TNXRV

SEQ ID NO: 1371 - protein, 5 aa, Artificial Sequence
  Description of Artificial Sequence: Synthetic peptide
  MOD_RES (3)..(3): Any amino acid
NQXPN

SEQ ID NO: 1372 - protein, 5 aa, Artificial Sequence
  Description of Artificial Sequence: Synthetic peptide
  MOD_RES (3)..(3): Any amino acid
IVXYT

SEQ ID NO: 1373 - protein, 5 aa, Artificial Sequence
  Description of Artificial Sequence: Synthetic peptide
  MOD_RES (3)..(3): Any amino acid
GHXAL

SEQ ID NO: 1374 - protein, 5 aa, Artificial Sequence
  Description of Artificial Sequence: Synthetic peptide
  MOD_RES (3)..(3): Any amino acid
TGXTF

SEQ ID NO: 1375 - protein, 5 aa, Artificial Sequence
  Description of Artificial Sequence: Synthetic peptide
  MOD_RES (3)..(3): Any amino acid
SSXGN

SEQ ID NO: 1376 - protein, 5 aa, Artificial Sequence
  Description of Artificial Sequence: Synthetic peptide
  MOD_RES (3)..(3): Any amino acid
HNXVN

SEQ ID NO: 1377 - protein, 5 aa, Artificial Sequence
  Description of Artificial Sequence: Synthetic peptide
  MOD_RES (3)..(3): Any amino acid
DAXGK

SEQ ID NO: 1378 - protein, 5 aa, Artificial Sequence
  Description of Artificial Sequence: Synthetic peptide
  MOD_RES (3)..(3): Any amino acid
CGXCW

SEQ ID NO: 1379 - protein, 5 aa, Artificial Sequence
  Description of Artificial Sequence: Synthetic peptide
  MOD_RES (3)..(3): Any amino acid
GSXVE

SEQ ID NO: 1380 - protein, 5 aa, Artificial Sequence
  Description of Artificial Sequence: Synthetic peptide
  MOD_RES (3)..(3): Any amino acid
TFXFY

SEQ ID NO: 1381 - protein, 5 aa, Artificial Sequence
  Description of Artificial Sequence: Synthetic peptide
  MOD_RES (3)..(3): Any amino acid
QGXGL

SEQ ID NO: 1382 - protein, 5 aa, Artificial Sequence
  Description of Artificial Sequence: Synthetic peptide
  MOD_RES (3)..(3): Any amino acid
SAXIG

SEQ ID NO: 1383 - protein, 5 aa, Artificial Sequence
  Description of Artificial Sequence: Synthetic peptide
  MOD_RES (3)..(3): Any amino acid
CSXGV

SEQ ID NO: 1384 - protein, 5 aa, Artificial Sequence
  Description of Artificial Sequence: Synthetic peptide
  MOD_RES (3)..(3): Any amino acid
FMXIL

SEQ ID NO: 1385 - protein, 5 aa, Artificial Sequence
  Description of Artificial Sequence: Synthetic peptide
  MOD_RES (3)..(3): Any amino acid
STXNT

SEQ ID NO: 1386 - protein, 5 aa, Artificial Sequence
  Description of Artificial Sequence: Synthetic peptide
  MOD_RES (3)..(3): Any amino acid
GQXIM

SEQ ID NO: 1387 - protein, 5 aa, Artificial Sequence
  Description of Artificial Sequence: Synthetic peptide
  MOD_RES (3)..(3): Any amino acid
YSXMS

SEQ ID NO: 1388 - protein, 5 aa, Artificial Sequence
  Description of Artificial Sequence: Synthetic peptide
  MOD_RES (3)..(3): Any amino acid
TMXRI

SEQ ID NO: 1389 - protein, 5 aa, Artificial Sequence
  Description of Artificial Sequence: Synthetic peptide
  MOD_RES (3)..(3): Any amino acid
ACXGD

SEQ ID NO: 1390 - protein, 5 aa, Artificial Sequence
  Description of Artificial Sequence: Synthetic peptide
  MOD_RES (3)..(3): Any amino acid
QGXGK

SEQ ID NO: 1391 - protein, 5 aa, Artificial Sequence
  Description of Artificial Sequence: Synthetic peptide
  MOD_RES (3)..(3): Any amino acid
QCXSC

SEQ ID NO: 1392 - protein, 5 aa, Artificial Sequence
  Description of Artificial Sequence: Synthetic peptide
  MOD_RES (3)..(3): Any amino acid
KRXNF

SEQ ID NO: 1393 - protein, 5 aa, Artificial Sequence
  Description of Artificial Sequence: Synthetic peptide
  MOD_RES (3)..(3): Any amino acid
NGXGK

SEQ ID NO: 1394 - protein, 5 aa, Artificial Sequence
  Description of Artificial Sequence: Synthetic peptide
  MOD_RES (3)..(3): Any amino acid
QVXGY

SEQ ID NO: 1395 - protein, 5 aa, Artificial Sequence
  Description of Artificial Sequence: Synthetic peptide
  MOD_RES (3)..(3): Any amino acid
KEXHP

SEQ ID NO: 1396 - protein, 5 aa, Artificial Sequence
  Description of Artificial Sequence: Synthetic peptide
  MOD_RES (3)..(3): Any amino acid
RGXGR

SEQ ID NO: 1397 - protein, 5 aa, Artificial Sequence
  Description of Artificial Sequence: Synthetic peptide
  MOD_RES (3)..(3): Any amino acid
LTXWK

SEQ ID NO: 1398 - protein, 5 aa, Artificial Sequence
  Description of Artificial Sequence: Synthetic peptide
  MOD_RES (3)..(3): Any amino acid
PGXGK

SEQ ID NO: 1399 - protein, 5 aa, Artificial Sequence
  Description of Artificial Sequence: Synthetic peptide
  MOD_RES (3)..(3): Any amino acid
APXVY

SEQ ID NO: 1400 - protein, 5 aa, Artificial Sequence
  Description of Artificial Sequence: Synthetic peptide
  MOD_RES (3)..(3): Any amino acid
HHXEL

SEQ ID NO: 1401 - protein, 5 aa, Artificial Sequence
  Description of Artificial Sequence: Synthetic peptide
  MOD_RES (3)..(3): Any amino acid
NVXKS

SEQ ID NO: 1402 - protein, 5 aa, Artificial Sequence
  Description of Artificial Sequence: Synthetic peptide
  MOD_RES (3)..(3): Any amino acid
PEXLT

SEQ ID NO: 1403 - protein, 5 aa, Artificial Sequence
  Description of Artificial Sequence: Synthetic peptide
  MOD_RES (3)..(3): Any amino acid
QGXCG

SEQ ID NO: 1404 - protein, 5 aa, Artificial Sequence
  Description of Artificial Sequence: Synthetic peptide
  MOD_RES (3)..(3): Any amino acid
HKXQS

SEQ ID NO: 1405 - protein, 5 aa, Artificial Sequence
  Description of Artificial Sequence: Synthetic peptide
  MOD_RES (4)..(4): Any amino acid
AGKXT

SEQ ID NO: 1406 - protein, 5 aa, Artificial Sequence
  Description of Artificial Sequence: Synthetic peptide
  MOD_RES (4)..(4): Any amino acid
SGKXT

SEQ ID NO: 1407 - protein, 5 aa, Artificial Sequence
  Description of Artificial Sequence: Synthetic peptide
  MOD_RES (4)..(4): Any amino acid
VGKXS

SEQ ID NO: 1408 - protein, 5 aa, Artificial Sequence
  Description of Artificial Sequence: Synthetic peptide
  MOD_RES (4)..(4): Any amino acid
TKVXK

SEQ ID NO: 1409 - protein, 5 aa, Artificial Sequence
  Description of Artificial Sequence: Synthetic peptide
  MOD_RES (4)..(4): Any amino acid
STKXD

SEQ ID NO: 1410 - protein, 5 aa, Artificial Sequence
  Description of Artificial Sequence: Synthetic peptide
  MOD_RES (4)..(4): Any amino acid
ACKXG

SEQ ID NO: 1411 - protein, 5 aa, Artificial Sequence
  Description of Artificial Sequence: Synthetic peptide
  MOD_RES (4)..(4): Any amino acid
GVGXS

SEQ ID NO: 1412 - protein, 5 aa, Artificial Sequence
  Description of Artificial Sequence: Synthetic peptide
  MOD_RES (4)..(4): Any amino acid
GFTXS

SEQ ID NO: 1413 - protein, 5 aa, Artificial Sequence
  Description of Artificial Sequence: Synthetic peptide
  MOD_RES (4)..(4): Any amino acid
CSAXI

SEQ ID NO: 1414 - protein, 5 aa, Artificial Sequence
  Description of Artificial Sequence: Synthetic peptide
  MOD_RES (4)..(4): Any amino acid
KVDXK

SEQ ID NO: 1415 - protein, 5 aa, Artificial Sequence
  Description of Artificial Sequence: Synthetic peptide
  MOD_RES (4)..(4): Any amino acid
QTGXT

SEQ ID NO: 1416 - protein, 5 aa, Artificial Sequence
  Description of Artificial Sequence: Synthetic peptide
  MOD_RES (4)..(4): Any amino acid
VACXN

SEQ ID NO: 1417 - protein, 5 aa, Artificial Sequence
  Description of Artificial Sequence: Synthetic peptide
  MOD_RES (4)..(4): Any amino acid
SAGXG

SEQ ID NO: 1418 - protein, 5 aa, Artificial Sequence
  Description of Artificial Sequence: Synthetic peptide
  MOD_RES (4)..(4): Any amino acid
TGTXK

SEQ ID NO: 1419 - protein, 5 aa, Artificial Sequence
  Description of Artificial Sequence: Synthetic peptide
  MOD_RES (4)..(4): Any amino acid
TQTXK

SEQ ID NO: 1420 - protein, 5 aa, Artificial Sequence
  Description of Artificial Sequence: Synthetic peptide
  MOD_RES (4)..(4): Any amino acid
SGVXK

SEQ ID NO: 1421 - protein, 5 aa, Artificial Sequence
  Description of Artificial Sequence: Synthetic peptide
  MOD_RES (4)..(4): Any amino acid
GSGXS

SEQ ID NO: 1422 - protein, 5 aa, Artificial Sequence
  Description of Artificial Sequence: Synthetic peptide
  MOD_RES (4)..(4): Any amino acid
GTGXT

SEQ ID NO: 1423 - protein, 5 aa, Artificial Sequence
  Description of Artificial Sequence: Synthetic peptide
  MOD_RES (4)..(4): Any amino acid
GLTXW

SEQ ID NO: 1424 - protein, 5 aa, Artificial Sequence
  Description of Artificial Sequence: Synthetic peptide
  MOD_RES (4)..(4): Any amino acid
NVAXK

SEQ ID NO: 1425 - protein, 5 aa, Artificial Sequence
  Description of Artificial Sequence: Synthetic peptide
  MOD_RES (4)..(4): Any amino acid
NAGXT

SEQ ID NO: 1426 - protein, 5 aa, Artificial Sequence
  Description of Artificial Sequence: Synthetic peptide
  MOD_RES (4)..(4): Any amino acid
QDKXG

SEQ ID NO: 1427 - protein, 5 aa, Artificial Sequence
  Description of Artificial Sequence: Synthetic peptide
  MOD_RES (4)..(4): Any amino acid
QSPXS

SEQ ID NO: 1428 - protein, 5 aa, Artificial Sequence
  Description of Artificial Sequence: Synthetic peptide
  MOD_RES (4)..(4): Any amino acid
QFNXN

SEQ ID NO: 1429 - protein, 5 aa, Artificial Sequence
  Description of Artificial Sequence: Synthetic peptide
  MOD_RES (4)..(4): Any amino acid
HTFXD

SEQ ID NO: 1430 - protein, 5 aa, Artificial Sequence
  Description of Artificial Sequence: Synthetic peptide
  MOD_RES (4)..(4): Any amino acid
HIAXV

SEQ ID NO: 1431 - protein, 5 aa, Artificial Sequence
  Description of Artificial Sequence: Synthetic peptide
  MOD_RES (4)..(4): Any amino acid
NKNXE

SEQ ID NO: 1432 - protein, 5 aa, Artificial Sequence
  Description of Artificial Sequence: Synthetic peptide
  MOD_RES (4)..(4): Any amino acid
KRSXA

SEQ ID NO: 1433 - protein, 5 aa, Artificial Sequence
  Description of Artificial Sequence: Synthetic peptide
  MOD_RES (4)..(4): Any amino acid
FADXL

SEQ ID NO: 1434 - protein, 5 aa, Artificial Sequence
  Description of Artificial Sequence: Synthetic peptide
  MOD_RES (4)..(4): Any amino acid
HESXN

SEQ ID NO: 1435 - protein, 5 aa, Artificial Sequence
  Description of Artificial Sequence: Synthetic peptide
  MOD_RES (4)..(4): Any amino acid
DASXN

SEQ ID NO: 1436 - protein, 5 aa, Artificial Sequence
  Description of Artificial Sequence: Synthetic peptide
  MOD_RES (4)..(4): Any amino acid
EYFXE

SEQ ID NO: 1437 - protein, 5 aa, Artificial Sequence
  Description of Artificial Sequence: Synthetic peptide
  MOD_RES (4)..(4): Any amino acid
SLFXE

SEQ ID NO: 1438 - protein, 5 aa, Artificial Sequence
  Description of Artificial Sequence: Synthetic peptide
  MOD_RES (4)..(4): Any amino acid
GYRXN

SEQ ID NO: 1439 - protein, 5 aa, Artificial Sequence
  Description of Artificial Sequence: Synthetic peptide
  MOD_RES (4)..(4): Any amino acid
DNAXK

SEQ ID NO: 1440 - protein, 5 aa, Artificial Sequence
  Description of Artificial Sequence: Synthetic peptide
  MOD_RES (4)..(4): Any amino acid
SSTXV

SEQ ID NO: 1441 - protein, 5 aa, Artificial Sequence
  Description of Artificial Sequence: Synthetic peptide
  MOD_RES (4)..(4): Any amino acid
TGKXT

SEQ ID NO: 1442 - protein, 5 aa, Artificial Sequence
  Description of Artificial Sequence: Synthetic peptide
  MOD_RES (4)..(4): Any amino acid
YASXR

SEQ ID NO: 1443 - protein, 5 aa, Artificial Sequence
  Description of Artificial Sequence: Synthetic peptide
  MOD_RES (4)..(4): Any amino acid
VGKXA

SEQ ID NO: 1444 - protein, 5 aa, Artificial Sequence
  Description of Artificial Sequence: Synthetic peptide
  MOD_RES (4)..(4): Any amino acid
TKMXF

SEQ ID NO: 1445 - protein, 5 aa, Artificial Sequence
  Description of Artificial Sequence: Synthetic peptide
  MOD_RES (4)..(4): Any amino acid
DGDXQ

SEQ ID NO: 1446 - protein, 5 aa, Artificial Sequence
  Description of Artificial Sequence: Synthetic peptide
  MOD_RES (4)..(4): Any amino acid
QTPXR

SEQ ID NO: 1447 - protein, 5 aa, Artificial Sequence
  Description of Artificial Sequence: Synthetic peptide
  MOD_RES (4)..(4): Any amino acid
ASGXT

SEQ ID NO: 1448 - protein, 5 aa, Artificial Sequence
  Description of Artificial Sequence: Synthetic peptide
  MOD_RES (4)..(4): Any amino acid
TGKXF

SEQ ID NO: 1449 - protein, 5 aa, Artificial Sequence
  Description of Artificial Sequence: Synthetic peptide
  MOD_RES (4)..(4): Any amino acid
NTKXD

SEQ ID NO: 1450 - protein, 5 aa, Artificial Sequence
  Description of Artificial Sequence: Synthetic peptide
  MOD_RES (4)..(4): Any amino acid
KNVXC

SEQ ID NO: 1451 - protein, 5 aa, Artificial Sequence
  Description of Artificial Sequence: Synthetic peptide
  MOD_RES (4)..(4): Any amino acid
SWGXG

SEQ ID NO: 1452 - protein, 5 aa, Artificial Sequence
  Description of Artificial Sequence: Synthetic peptide
  MOD_RES (4)..(4): Any amino acid
LGNXC

SEQ ID NO: 1453 - protein, 5 aa, Artificial Sequence
  Description of Artificial Sequence: Synthetic peptide
  MOD_RES (4)..(4): Any amino acid
GNIXR

SEQ ID NO: 1454 - protein, 5 aa, Artificial Sequence
  Description of Artificial Sequence: Synthetic peptide
  MOD_RES (4)..(4): Any amino acid
PGHXA

SEQ ID NO: 1455 - protein, 5 aa, Artificial Sequence
  Description of Artificial Sequence: Synthetic peptide
  MOD_RES (4)..(4): Any amino acid
PPGXP

SEQ ID NO: 1456 - protein, 5 aa, Artificial Sequence
  Description of Artificial Sequence: Synthetic peptide
  MOD_RES (4)..(4): Any amino acid
PTWXI

SEQ ID NO: 1457 - protein, 5 aa, Artificial Sequence
  Description of Artificial Sequence: Synthetic peptide
  MOD_RES (4)..(4): Any amino acid
AGVXR

SEQ ID NO: 1458 - protein, 5 aa, Artificial Sequence
  Description of Artificial Sequence: Synthetic peptide
  MOD_RES (4)..(4): Any amino acid
GYWXD

SEQ ID NO: 1459 - protein, 5 aa, Artificial Sequence
  Description of Artificial Sequence: Synthetic peptide
  MOD_RES (4)..(4): Any amino acid
LGFXI

SEQ ID NO: 1460 - protein, 5 aa, Artificial Sequence
  Description of Artificial Sequence: Synthetic peptide
  MOD_RES (4)..(4): Any amino acid
AAGXT

SEQ ID NO: 1461 - protein, 5 aa, Artificial Sequence
  Description of Artificial Sequence: Synthetic peptide
  MOD_RES (4)..(4): Any amino acid
VGKXT

SEQ ID NO: 1462 - protein, 5 aa, Artificial Sequence
  Description of Artificial Sequence: Synthetic peptide
  MOD_RES (4)..(4): Any amino acid
GAGXT

SEQ ID NO: 1463 - protein, 5 aa, Artificial Sequence
  Description of Artificial Sequence: Synthetic peptide
  MOD_RES (4)..(4): Any amino acid
GSTXE

SEQ ID NO: 1464 - protein, 5 aa, Artificial Sequence
  Description of Artificial Sequence: Synthetic peptide
  MOD_RES (4)..(4): Any amino acid
TFKXY

SEQ ID NO: 1465 - protein, 5 aa, Artificial Sequence
  Description of Artificial Sequence: Synthetic peptide
  MOD_RES (4)..(4): Any amino acid
CLGXI

SEQ ID NO: 1466 - protein, 5 aa, Artificial Sequence
  Description of Artificial Sequence: Synthetic peptide
  MOD_RES (4)..(4): Any amino acid
DAAXK

SEQ ID NO: 1467 - protein, 5 aa, Artificial Sequence
  Description of Artificial Sequence: Synthetic peptide
  MOD_RES (4)..(4): Any amino acid
GSGXT

SEQ ID NO: 1468 - protein, 5 aa, Artificial Sequence
  Description of Artificial Sequence: Synthetic peptide
  MOD_RES (4)..(4): Any amino acid
LGIXI

SEQ ID NO: 1469 - protein, 5 aa, Artificial Sequence
  Description of Artificial Sequence: Synthetic peptide
  MOD_RES (4)..(4): Any amino acid
QGSXK

SEQ ID NO: 1470 - protein, 5 aa, Artificial Sequence
  Description of Artificial Sequence: Synthetic peptide
  MOD_RES (4)..(4): Any amino acid
IVNXT

SEQ ID NO: 1471 - protein, 5 aa, Artificial Sequence
  Description of Artificial Sequence: Synthetic peptide
  MOD_RES (4)..(4): Any amino acid
FMRXL

SEQ ID NO: 1472 - protein, 5 aa, Artificial Sequence
  Description of Artificial Sequence: Synthetic peptide
  MOD_RES (4)..(4): Any amino acid
DKPXY

SEQ ID NO: 1473 - protein, 5 aa, Artificial Sequence
  Description of Artificial Sequence: Synthetic peptide
  MOD_RES (4)..(4): Any amino acid
CSAXV

SEQ ID NO: 1474 - protein, 5 aa, Artificial Sequence
  Description of Artificial Sequence: Synthetic peptide
  MOD_RES (4)..(4): Any amino acid
QGKXS

SEQ ID NO: 1475 - protein, 5 aa, Artificial Sequence
  Description of Artificial Sequence: Synthetic peptide
  MOD_RES (4)..(4): Any amino acid
FPEXL

SEQ ID NO: 1476 - protein, 5 aa, Artificial Sequence
  Description of Artificial Sequence: Synthetic peptide
  MOD_RES (4)..(4): Any amino acid
VSWXR

SEQ ID NO: 1477 - protein, 5 aa, Artificial Sequence
  Description of Artificial Sequence: Synthetic peptide
  MOD_RES (4)..(4): Any amino acid
ETGXS

SEQ ID NO: 1478 - protein, 5 aa, Artificial Sequence
  Description of Artificial Sequence: Synthetic peptide
  MOD_RES (4)..(4): Any amino acid
NGGXM

SEQ ID NO: 1479 - protein, 5 aa, Artificial Sequence
  Description of Artificial Sequence: Synthetic peptide
  MOD_RES (4)..(4): Any amino acid
DMNXE

SEQ ID NO: 1480 - protein, 5 aa, Artificial Sequence
  Description of Artificial Sequence: Synthetic peptide
  MOD_RES (4)..(4): Any amino acid
NVGXS

SEQ ID NO: 1481 - protein, 5 aa, Artificial Sequence
  Description of Artificial Sequence: Synthetic peptide
  MOD_RES (4)..(4): Any amino acid
YTPXL

SEQ ID NO: 1482 - protein, 5 aa, Artificial Sequence
  Description of Artificial Sequence: Synthetic peptide
  MOD_RES (4)..(4): Any amino acid
TGAXK

SEQ ID NO: 1483 - protein, 5 aa, Artificial Sequence
  Description of Artificial Sequence: Synthetic peptide
  MOD_RES (4)..(4): Any amino acid
GTFXC

SEQ ID NO: 1484 - protein, 5 aa, Artificial Sequence
  Description of Artificial Sequence: Synthetic peptide
  MOD_RES (4)..(4): Any amino acid
HALXV

SEQ ID NO: 1485 - protein, 5 aa, Artificial Sequence
  Description of Artificial Sequence: Synthetic peptide
  MOD_RES (4)..(4): Any amino acid
AGIXR

SEQ ID NO: 1486 - protein, 5 aa, Artificial Sequence
  Description of Artificial Sequence: Synthetic peptide
  MOD_RES (4)..(4): Any amino acid
GAGXS

SEQ ID NO: 1487 - protein, 5 aa, Artificial Sequence
  Description of Artificial Sequence: Synthetic peptide
  MOD_RES (4)..(4): Any amino acid
ELCXL

SEQ ID NO: 1488 - protein, 5 aa, Artificial Sequence
  Description of Artificial Sequence: Synthetic peptide
  MOD_RES (4)..(4): Any amino acid
DHGXT

SEQ ID NO: 1489 - protein, 5 aa, Artificial Sequence
  Description of Artificial Sequence: Synthetic peptide
  MOD_RES (4)..(4): Any amino acid
VGKXC

SEQ ID NO: 1490 - protein, 5 aa, Artificial Sequence
  Description of Artificial Sequence: Synthetic peptide
  MOD_RES (4)..(4): Any amino acid
NQTXN

SEQ ID NO: 1491 - protein, 5 aa, Artificial Sequence
  Description of Artificial Sequence: Synthetic peptide
  MOD_RES (4)..(4): Any amino acid
GGTXK

SEQ ID NO: 1492 - protein, 5 aa, Artificial Sequence
  Description of Artificial Sequence: Synthetic peptide
  MOD_RES (4)..(4): Any amino acid
GLGXS

SEQ ID NO: 1493 - protein, 5 aa, Artificial Sequence
  Description of Artificial Sequence: Synthetic peptide
  MOD_RES (4)..(4): Any amino acid
WGRXV

SEQ ID NO: 1494 - protein, 5 aa, Artificial Sequence
  Description of Artificial Sequence: Synthetic peptide
  MOD_RES (4)..(4): Any amino acid
AGIXR

SEQ ID NO: 1495 - protein, 5 aa, Artificial Sequence
  Description of Artificial Sequence: Synthetic peptide
  MOD_RES (4)..(4): Any amino acid
QCGXC

SEQ ID NO: 1496 - protein, 5 aa, Artificial Sequence
  Description of Artificial Sequence: Synthetic peptide
  MOD_RES (4)..(4): Any amino acid
SSTXN

SEQ ID NO: 1497 - protein, 5 aa, Artificial Sequence
  Description of Artificial Sequence: Synthetic peptide
  MOD_RES (4)..(4): Any amino acid
MELXT

SEQ ID NO: 1498 - protein, 5 aa, Artificial Sequence
  Description of Artificial Sequence: Synthetic peptide
  MOD_RES (4)..(4): Any amino acid
QGIXS

SEQ ID NO: 1499 - protein, 5 aa, Artificial Sequence
  Description of Artificial Sequence: Synthetic peptide
  MOD_RES (4)..(4): Any amino acid
HGKXT

SEQ ID NO: 1500 - protein, 5 aa, Artificial Sequence
  Description of Artificial Sequence: Synthetic peptide
  MOD_RES (4)..(4): Any amino acid
ATNXR

SEQ ID NO: 1501 - protein, 5 aa, Artificial Sequence
  Description of Artificial Sequence: Synthetic peptide
  MOD_RES (4)..(4): Any amino acid
GQGXG

SEQ ID NO: 1502 - protein, 5 aa, Artificial Sequence
  Description of Artificial Sequence: Synthetic peptide
  MOD_RES (4)..(4): Any amino acid
RIVXY

SEQ ID NO: 1503 - protein, 5 aa, Artificial Sequence
  Description of Artificial Sequence: Synthetic peptide
  MOD_RES (4)..(4): Any amino acid
RGLXR

SEQ ID NO: 1504 - protein, 5 aa, Artificial Sequence
  Description of Artificial Sequence: Synthetic peptide
AGKTT

SEQ ID NO: 1505 - protein, 5 aa, Artificial Sequence
  Description of Artificial Sequence: Synthetic peptide
TKVDK

SEQ ID NO: 1506 - protein, 5 aa, Artificial Sequence
  Description of Artificial Sequence: Synthetic peptide
STKVD

SEQ ID NO: 1507 - protein, 5 aa, Artificial Sequence
  Description of Artificial Sequence: Synthetic peptide
GVGKS

SEQ ID NO: 1508 - protein, 5 aa, Artificial Sequence
  Description of Artificial Sequence: Synthetic peptide
KVDKK

SEQ ID NO: 1509 - protein, 5 aa, Artificial Sequence
  Description of Artificial Sequence: Synthetic peptide
CSAGI

SEQ ID NO: 1510 - protein, 5 aa, Artificial Sequence
  Description of Artificial Sequence: Synthetic peptide
SGKST

SEQ ID NO: 1511 - protein, 5 aa, Artificial Sequence
  Description of Artificial Sequence: Synthetic peptide
GFTNS

SEQ ID NO: 1512 - protein, 5 aa, Artificial Sequence
  Description of Artificial Sequence: Synthetic peptide
VGKSS

SEQ ID NO: 1513 - protein, 5 aa, Artificial Sequence
  Description of Artificial Sequence: Synthetic peptide
SGKTT

SEQ ID NO: 1514 - protein, 5 aa, Artificial Sequence
  Description of Artificial Sequence: Synthetic peptide
GSGKS

SEQ ID NO: 1515 - protein, 5 aa, Artificial Sequence
  Description of Artificial Sequence: Synthetic peptide
SGVGK

SEQ ID NO: 1516 - protein, 5 aa, Artificial Sequence
  Description of Artificial Sequence: Synthetic peptide
NVACK

SEQ ID NO: 1517 - protein, 5 aa, Artificial Sequence
  Description of Artificial Sequence: Synthetic peptide
VGKTS

SEQ ID NO: 1518 - protein, 5 aa, Artificial Sequence
  Description of Artificial Sequence: Synthetic peptide
DNAGK

SEQ ID NO: 1519 - protein, 5 aa, Artificial Sequence
  Description of Artificial Sequence: Synthetic peptide
NAGKT

SEQ ID NO: 1520 - protein, 5 aa, Artificial Sequence
  Description of Artificial Sequence: Synthetic peptide
GTGKT

SEQ ID NO: 1521 - protein, 5 aa, Artificial Sequence
  Description of Artificial Sequence: Synthetic peptide
SSTKV

SEQ ID NO: 1522 - protein, 5 aa, Artificial Sequence
  Description of Artificial Sequence: Synthetic peptide
QTGKT

SEQ ID NO: 1523 - protein, 5 aa, Artificial Sequence
  Description of Artificial Sequence: Synthetic peptide
TQTGK

SEQ ID NO: 1524 - protein, 5 aa, Artificial Sequence
  Description of Artificial Sequence: Synthetic peptide
AGIGR

SEQ ID NO: 1525 - protein, 5 aa, Artificial Sequence
  Description of Artificial Sequence: Synthetic peptide
VACKN

SEQ ID NO: 1526 - protein, 5 aa, Artificial Sequence
  Description of Artificial Sequence: Synthetic peptide
ACKNG

SEQ ID NO: 1527 - protein, 5 aa, Artificial Sequence
  Description of Artificial Sequence: Synthetic peptide
NTKVD

SEQ ID NO: 1528 - protein, 5 aa, Artificial Sequence
  Description of Artificial Sequence: Synthetic peptide
VGKSA

SEQ ID NO: 1529 - protein, 5 aa, Artificial Sequence
  Description of Artificial Sequence: Synthetic peptide
TGTGK

SEQ ID NO: 1530 - protein, 5 aa, Artificial Sequence
  Description of Artificial Sequence: Synthetic peptide
CSAGV

SEQ ID NO: 1531 - protein, 5 aa, Artificial Sequence
  Description of Artificial Sequence: Synthetic peptide
GLTDW

SEQ ID NO: 1532 - protein, 5 aa, Artificial Sequence
  Description of Artificial Sequence: Synthetic peptide
YASGR

SEQ ID NO: 1533 - protein, 5 aa, Artificial Sequence
  Description of Artificial Sequence: Synthetic peptide
TDVVG

SEQ ID NO: 1534 - protein, 5 aa, Artificial Sequence
  Description of Artificial Sequence: Synthetic peptide
GTDVV

SEQ ID NO: 1535 - protein, 5 aa, Artificial Sequence
  Description of Artificial Sequence: Synthetic peptide
ASGRT

SEQ ID NO: 1536 - protein, 5 aa, Artificial Sequence
  Description of Artificial Sequence: Synthetic peptide
AAGKT

SEQ ID NO: 1537 - protein, 5 aa, Artificial Sequence
  Description of Artificial Sequence: Synthetic peptide
GAGKT

SEQ ID NO: 1538 - protein, 5 aa, Artificial Sequence
  Description of Artificial Sequence: Synthetic peptide
QSTYS

SEQ ID NO: 1539 - protein, 5 aa, Artificial Sequence
  Description of Artificial Sequence: Synthetic peptide
IASVA

SEQ ID NO: 1540 - protein, 5 aa, Artificial Sequence
  Description of Artificial Sequence: Synthetic peptide
HTFID

SEQ ID NO: 1541 - protein, 5 aa, Artificial Sequence
  Description of Artificial Sequence: Synthetic peptide
HIASV

SEQ ID NO: 1542 - protein, 5 aa, Artificial Sequence
  Description of Artificial Sequence: Synthetic peptide
SRTGT

SEQ ID NO: 1543 - protein, 5 aa, Artificial Sequence
  Description of Artificial Sequence: Synthetic peptide
PSLPT

SEQ ID NO: 1544 - protein, 5 aa, Artificial Sequence
  Description of Artificial Sequence: Synthetic peptide
FADKL

SEQ ID NO: 1545 - protein, 5 aa, Artificial Sequence
  Description of Artificial Sequence: Synthetic peptide
HESEN

SEQ ID NO: 1546 - protein, 5 aa, Artificial Sequence
  Description of Artificial Sequence: Synthetic peptide
GTMKP

SEQ ID NO: 1547 - protein, 5 aa, Artificial Sequence
  Description of Artificial Sequence: Synthetic peptide
TQQHG

SEQ ID NO: 1548 - protein, 5 aa, Artificial Sequence
  Description of Artificial Sequence: Synthetic peptide
YIKIH

SEQ ID NO: 1549 - protein, 5 aa, Artificial Sequence
  Description of Artificial Sequence: Synthetic peptide
ITTLD

SEQ ID NO: 1550 - protein, 5 aa, Artificial Sequence
  Description of Artificial Sequence: Synthetic peptide
NALAS

SEQ ID NO: 1551 - protein, 5 aa, Artificial Sequence
  Description of Artificial Sequence: Synthetic peptide
RGFSG

SEQ ID NO: 1552 - protein, 5 aa, Artificial Sequence
  Description of Artificial Sequence: Synthetic peptide
SLFLE

SEQ ID NO: 1553 - protein, 5 aa, Artificial Sequence
  Description of Artificial Sequence: Synthetic peptide
GYRDN

SEQ ID NO: 1554 - protein, 5 aa, Artificial Sequence
  Description of Artificial Sequence: Synthetic peptide
QFNTN

SEQ ID NO: 1555 - protein, 5 aa, Artificial Sequence
  Description of Artificial Sequence: Synthetic peptide
DAAGK

SEQ ID NO: 1556 - protein, 5 aa, Artificial Sequence
  Description of Artificial Sequence: Synthetic peptide
LGNIC

SEQ ID NO: 1557 - protein, 5 aa, Artificial Sequence
  Description of Artificial Sequence: Synthetic peptide
CLGNI

SEQ ID NO: 1558 - protein, 5 aa, Artificial Sequence
  Description of Artificial Sequence: Synthetic peptide
PPGPP

SEQ ID NO: 1559 - protein, 5 aa, Artificial Sequence
  Description of Artificial Sequence: Synthetic peptide
GNICR

SEQ ID NO: 1560 - protein, 5 aa, Artificial Sequence
  Description of Artificial Sequence: Synthetic peptide
QDKEG

SEQ ID NO: 1561 - protein, 5 aa, Artificial Sequence
  Description of Artificial Sequence: Synthetic peptide
AGVGR

SEQ ID NO: 1562 - protein, 5 aa, Artificial Sequence
  Description of Artificial Sequence: Synthetic peptide
HALAV

SEQ ID NO: 1563 - protein, 5 aa, Artificial Sequence
  Description of Artificial Sequence: Synthetic peptide
NVGKS

SEQ ID NO: 1564 - protein, 5 aa, Artificial Sequence
  Description of Artificial Sequence: Synthetic peptide
SAGIG

SEQ ID NO: 1565 - protein, 5 aa, Artificial Sequence
  Description of Artificial Sequence: Synthetic peptide
TGKTF

SEQ ID NO: 1566 - protein, 5 aa, Artificial Sequence
  Description of Artificial Sequence: Synthetic peptide
GSGKT

SEQ ID NO: 1567 - protein, 5 aa, Artificial Sequence
  Description of Artificial Sequence: Synthetic peptide
QTPNR

SEQ ID NO: 1568 - protein, 5 aa, Artificial Sequence
  Description of Artificial Sequence: Synthetic peptide
SAGVG

SEQ ID NO: 1569 - protein, 5 aa, Artificial Sequence
  Description of Artificial Sequence: Synthetic peptide
GSTVE

SEQ ID NO: 1570 - protein, 5 aa, Artificial Sequence
  Description of Artificial Sequence: Synthetic peptide
AGIGR

SEQ ID NO: 1571 - protein, 5 aa, Artificial Sequence
  Description of Artificial Sequence: Synthetic peptide
MELCT

SEQ ID NO: 1572 - protein, 5 aa, Artificial Sequence
  Description of Artificial Sequence: Synthetic peptide
KNVAC

SEQ ID NO: 1573 - protein, 5 aa, Artificial Sequence
  Description of Artificial Sequence: Synthetic peptide
ACNGD

SEQ ID NO: 1574 - protein, 5 aa, Artificial Sequence
  Description of Artificial Sequence: Synthetic peptide
RGLGR

SEQ ID NO: 1575 - protein, 5 aa, Artificial Sequence
  Description of Artificial Sequence: Synthetic peptide
TWNIG

SEQ ID NO: 1576 - protein, 5 aa, Artificial Sequence
  Description of Artificial Sequence: Synthetic peptide
PTWNI

SEQ ID NO: 1577 - protein, 5 aa, Artificial Sequence
  Description of Artificial Sequence: Synthetic peptide
GGTGK

SEQ ID NO: 1578 - protein, 5 aa, Artificial Sequence
  Description of Artificial Sequence: Synthetic peptide
VGKSN

SEQ ID NO: 1579 - protein, 5 aa, Artificial Sequence
  Description of Artificial Sequence: Synthetic peptide
GAGKS

SEQ ID NO: 1580 - protein, 5 aa, Artificial Sequence
  Description of Artificial Sequence: Synthetic peptide
TGAGK

SEQ ID NO: 1581 - protein, 5 aa, Artificial Sequence
  Description of Artificial Sequence: Synthetic peptide
QGIMS

SEQ ID NO: 1582 - protein, 5 aa, Artificial Sequence
  Description of Artificial Sequence: Synthetic peptide
DHGKT

SEQ ID NO: 1583 - protein, 5 aa, Artificial Sequence
  Description of Artificial Sequence: Synthetic peptide
IVNYT

SEQ ID NO: 1584 - protein, 5 aa, Artificial Sequence
  Description of Artificial Sequence: Synthetic peptide
TGKTT

SEQ ID NO: 1585 - protein, 5 aa, Artificial Sequence
  Description of Artificial Sequence: Synthetic peptide
FMRIL

SEQ ID NO: 1586 - protein, 5 aa, Artificial Sequence
  Description of Artificial Sequence: Synthetic peptide
VGKST

SEQ ID NO: 1587 - protein, 5 aa, Artificial Sequence
  Description of Artificial Sequence: Synthetic peptide
PNVGK

SEQ ID NO: 1588 - protein, 5 aa, Artificial Sequence
  Description of Artificial Sequence: Synthetic peptide
TFKFY

SEQ ID NO: 1589 - protein, 5 aa, Artificial Sequence
  Description of Artificial Sequence: Synthetic peptide
SAGIG

SEQ ID NO: 1590 - protein, 5 aa, Artificial Sequence
  Description of Artificial Sequence: Synthetic peptide
SPSSL

SEQ ID NO: 1591 - protein, 5 aa, Artificial Sequence
  Description of Artificial Sequence: Synthetic peptide
AGKST

SEQ ID NO: 1592 - protein, 5 aa, Artificial Sequence
  Description of Artificial Sequence: Synthetic peptide
NQTPN

SEQ ID NO: 1593 - protein, 5 aa, Artificial Sequence
  Description of Artificial Sequence: Synthetic peptide
AGKTS

SEQ ID NO: 1594 - protein, 5 aa, Artificial Sequence
  Description of Artificial Sequence: Synthetic peptide
QGSGK

SEQ ID NO: 1595 - protein, 5 aa, Artificial Sequence
  Description of Artificial Sequence: Synthetic peptide
STGNT

SEQ ID NO: 1596 - protein, 5 aa, Artificial Sequence
  Description of Artificial Sequence: Synthetic peptide
HGKTT

SEQ ID NO: 1597 - protein, 5 aa, Artificial Sequence
  Description of Artificial Sequence: Synthetic peptide
SGSGK

SEQ ID NO: 1598 - protein, 5 aa, Artificial Sequence
  Description of Artificial Sequence: Synthetic peptide
GQGIM

SEQ ID NO: 1599 - protein, 5 aa, Artificial Sequence
  Description of Artificial Sequence: Synthetic peptide
YSTMS

SEQ ID NO: 1600 - protein, 5 aa, Artificial Sequence
  Description of Artificial Sequence: Synthetic peptide
QTGTG

SEQ ID NO: 1601 - protein, 5 aa, Artificial Sequence
  Description of Artificial Sequence: Synthetic peptide
VSWGR

SEQ ID NO: 1602 - protein, 5 aa, Artificial Sequence
  Description of Artificial Sequence: Synthetic peptide
FTVAQ

SEQ ID NO: 1603 - protein, 6 aa, Artificial Sequence
  Description of Artificial Sequence: Synthetic peptide
  MOD_RES (2)..(5): Any amino acid
LXXXXR

SEQ ID NO: 1604 - protein, 6 aa, Artificial Sequence
  Description of Artificial Sequence: Synthetic peptide
  MOD_RES (2)..(5): Any amino acid
GXXXXQ

SEQ ID NO: 1605 - protein, 6 aa, Artificial Sequence
  Description of Artificial Sequence: Synthetic peptide
  MOD_RES (2)..(5): Any amino acid
LXXXXQ

SEQ ID NO: 1606 - protein, 6 aa, Artificial Sequence
  Description of Artificial Sequence: Synthetic peptide
  MOD_RES (2)..(5): Any amino acid
LXXXXK

SEQ ID NO: 1607 - protein, 6 aa, Artificial Sequence
  Description of Artificial Sequence: Synthetic peptide
  MOD_RES (2)..(5): Any amino acid
GXXXXE

SEQ ID NO: 1608 - protein, 6 aa, Artificial Sequence
  Description of Artificial Sequence: Synthetic peptide
  MOD_RES (2)..(5): Any amino acid
LXXXXM

SEQ ID NO: 1609 - protein, 6 aa, Artificial Sequence
  Description of Artificial Sequence: Synthetic peptide
  MOD_RES (2)..(5): Any amino acid
GXXXXT

SEQ ID NO: 1610 - protein, 6 aa, Artificial Sequence
  Description of Artificial Sequence: Synthetic peptide
  MOD_RES (2)..(5): Any amino acid
LXXXXI

SEQ ID NO: 1611 - protein, 6 aa, Artificial Sequence
  Description of Artificial Sequence: Synthetic peptide
  MOD_RES (2)..(5): Any amino acid
AXXXXV

SEQ ID NO: 1612 - protein, 6 aa, Artificial Sequence
  Description of Artificial Sequence: Synthetic peptide
  MOD_RES (2)..(5): Any amino acid
EXXXXW

SEQ ID NO: 1613 - protein, 6 aa, Artificial Sequence
  Description of Artificial Sequence: Synthetic peptide
  MOD_RES (2)..(5): Any amino acid
IXXXXR

SEQ ID NO: 1614 - protein, 6 aa, Artificial Sequence
  Description of Artificial Sequence: Synthetic peptide
  MOD_RES (2)..(5): Any amino acid
SXXXXR

SEQ ID NO: 1615 - protein, 6 aa, Artificial Sequence
  Description of Artificial Sequence: Synthetic peptide
  MOD_RES (2)..(5): Any amino acid
AXXXXR

SEQ ID NO: 1616 - protein, 6 aa, Artificial Sequence
  Description of Artificial Sequence: Synthetic peptide
  MOD_RES (2)..(5): Any amino acid
AXXXXI

SEQ ID NO: 1617 - protein, 6 aa, Artificial Sequence
  Description of Artificial Sequence: Synthetic peptide
  MOD_RES (2)..(5): Any amino acid
EXXXXR

SEQ ID NO: 1618 - protein, 6 aa, Artificial Sequence
  Description of Artificial Sequence: Synthetic peptide
  MOD_RES (2)..(5): Any amino acid
RXXXXE

SEQ ID NO: 1619 - protein, 6 aa, Artificial Sequence
  Description of Artificial Sequence: Synthetic peptide
  MOD_RES (2)..(5): Any amino acid
SXXXXQ

SEQ ID NO: 1620 - protein, 6 aa, Artificial Sequence
  Description of Artificial Sequence: Synthetic peptide
  MOD_RES (2)..(5): Any amino acid
NXXXXE

SEQ ID NO: 1621 - protein, 6 aa, Artificial Sequence
  Description of Artificial Sequence: Synthetic peptide
  MOD_RES (2)..(5): Any amino acid
GXXXXS

SEQ ID NO: 1622 - protein, 6 aa, Artificial Sequence
  Description of Artificial Sequence: Synthetic peptide
  MOD_RES (2)..(5): Any amino acid
LXXXXL

SEQ ID NO: 1623 - protein, 6 aa, Artificial Sequence
  Description of Artificial Sequence: Synthetic peptide
  MOD_RES (2)..(5): Any amino acid
TXXXXR

SEQ ID NO: 1624 - protein, 6 aa, Artificial Sequence
  Description of Artificial Sequence: Synthetic peptide
  MOD_RES (2)..(5): Any amino acid
SXXXXR

SEQ ID NO: 1625 - protein, 6 aa, Artificial Sequence
  Description of Artificial Sequence: Synthetic peptide
  MOD_RES (2)..(5): Any amino acid
FXXXXR

SEQ ID NO: 1626 - protein, 6 aa, Artificial Sequence
  Description of Artificial Sequence: Synthetic peptide
  MOD_RES (2)..(5): Any amino acid
SXXXXE

SEQ ID NO: 1627 - protein, 6 aa, Artificial Sequence
  Description of Artificial Sequence: Synthetic peptide
  MOD_RES (2)..(5): Any amino acid
VXXXXF

SEQ ID NO: 1628 - protein, 6 aa, Artificial Sequence
  Description of Artificial Sequence: Synthetic peptide
  MOD_RES (2)..(5): Any amino acid
FXXXXE

SEQ ID NO: 1629 - protein, 6 aa, Artificial Sequence
  Description of Artificial Sequence: Synthetic peptide
  MOD_RES (2)..(5): Any amino acid
GXXXXD

SEQ ID NO: 1630 - protein, 6 aa, Artificial Sequence
  Description of Artificial Sequence: Synthetic peptide
  MOD_RES (2)..(5): Any amino acid
TXXXXT

SEQ ID NO: 1631 - protein, 6 aa, Artificial Sequence
  Description of Artificial Sequence: Synthetic peptide
  MOD_RES (2)..(5): Any amino acid
TXXXXE

SEQ ID NO: 1632 - protein, 6 aa, Artificial Sequence
  Description of Artificial Sequence: Synthetic peptide
  MOD_RES (2)..(5): Any amino acid
KXXXXW

SEQ ID NO: 1633 - protein, 6 aa, Artificial Sequence
  Description of Artificial Sequence: Synthetic peptide
  MOD_RES (2)..(5): Any amino acid
DXXXXR

SEQ ID NO: 1634 - protein, 6 aa, Artificial Sequence
  Description of Artificial Sequence: Synthetic peptide
  MOD_RES (2)..(5): Any amino acid
YXXXXE

SEQ ID NO: 1635 - protein, 6 aa, Artificial Sequence
  Description of Artificial Sequence: Synthetic peptide
  MOD_RES (2)..(5): Any amino acid
LXXXXI

SEQ ID NO: 1636 - protein, 6 aa, Artificial Sequence
  Description of Artificial Sequence: Synthetic peptide
  MOD_RES (2)..(5): Any amino acid
RXXXXF

SEQ ID NO: 1637 - protein, 6 aa, Artificial Sequence
  Description of Artificial Sequence: Synthetic peptide
  MOD_RES (2)..(5): Any amino acid
KXXXXY

SEQ ID NO: 1638 - protein, 6 aa, Artificial Sequence
  Description of Artificial Sequence: Synthetic peptide
  MOD_RES (2)..(5): Any amino acid
GXXXXR

SEQ ID NO: 1639 - protein, 6 aa, Artificial Sequence
  Description of Artificial Sequence: Synthetic peptide
  MOD_RES (2)..(5): Any amino acid
GXXXXR

SEQ ID NO: 1640 - protein, 6 aa, Artificial Sequence
  Description of Artificial Sequence: Synthetic peptide
  MOD_RES (2)..(5): Any amino acid
EXXXXE

SEQ ID NO: 1641 - protein, 6 aa, Artificial Sequence
  Description of Artificial Sequence: Synthetic peptide
  MOD_RES (2)..(5): Any amino acid
GXXXXN

SEQ ID NO: 1642 - protein, 6 aa, Artificial Sequence
  Description of Artificial Sequence: Synthetic peptide
  MOD_RES (2)..(5): Any amino acid
QXXXXT

SEQ ID NO: 1643 - protein, 6 aa, Artificial Sequence
  Description of Artificial Sequence: Synthetic peptide
  MOD_RES (2)..(5): Any amino acid
VXXXXQ

SEQ ID NO: 1644 - protein, 6 aa, Artificial Sequence
  Description of Artificial Sequence: Synthetic peptide
  MOD_RES (2)..(5): Any amino acid
RXXXXD

SEQ ID NO: 1645 - protein, 6 aa, Artificial Sequence
  Description of Artificial Sequence: Synthetic peptide
  MOD_RES (2)..(5): Any amino acid
FXXXXE

SEQ ID NO: 1646 - protein, 6 aa, Artificial Sequence
  Description of Artificial Sequence: Synthetic peptide
  MOD_RES (2)..(5): Any amino acid
LXXXXV

SEQ ID NO: 1647 - protein, 6 aa, Artificial Sequence
  Description of Artificial Sequence: Synthetic peptide
  MOD_RES (2)..(5): Any amino acid
RXXXXH

SEQ ID NO: 1648 - protein, 6 aa, Artificial Sequence
  Description of Artificial Sequence: Synthetic peptide
  MOD_RES (2)..(5): Any amino acid
GXXXXY

SEQ ID NO: 1649 - protein, 6 aa, Artificial Sequence
  Description of Artificial Sequence: Synthetic peptide
  MOD_RES (2)..(5): Any amino acid
AXXXXE

SEQ ID NO: 1650 - protein, 6 aa, Artificial Sequence
  Description of Artificial Sequence: Synthetic peptide
  MOD_RES (2)..(5): Any amino acid
WXXXXR

SEQ ID NO: 1651 - protein, 6 aa, Artificial Sequence
  Description of Artificial Sequence: Synthetic peptide
  MOD_RES (2)..(5): Any amino acid
DXXXXT

SEQ ID NO: 1652 - protein, 6 aa, Artificial Sequence
  Description of Artificial Sequence: Synthetic peptide
  MOD_RES (2)..(5): Any amino acid
PXXXXQ

SEQ ID NO: 1653 - protein, 6 aa, Artificial Sequence
  Description of Artificial Sequence: Synthetic peptide
  MOD_RES (2)..(5): Any amino acid
DXXXXR

SEQ ID NO: 1654 - protein, 6 aa, Artificial Sequence
  Description of Artificial Sequence: Synthetic peptide
  MOD_RES (2)..(5): Any amino acid
GXXXXK

SEQ ID NO: 1655 - protein, 6 aa, Artificial Sequence
  Description of Artificial Sequence: Synthetic peptide
  MOD_RES (2)..(5): Any amino acid
TXXXXR

SEQ ID NO: 1656 - protein, 6 aa, Artificial Sequence
  Description of Artificial Sequence: Synthetic peptide
  MOD_RES (2)..(5): Any amino acid
RXXXXQ

SEQ ID NO: 1657 - protein, 6 aa, Artificial Sequence
  Description of Artificial Sequence: Synthetic peptide
  MOD_RES (2)..(5): Any amino acid
YXXXXG

SEQ ID NO: 1658 - protein, 6 aa, Artificial Sequence
  Description of Artificial Sequence: Synthetic peptide
  MOD_RES (2)..(5): Any amino acid
QXXXXE

SEQ ID NO: 1659 - protein, 6 aa, Artificial Sequence
  Description of Artificial Sequence: Synthetic peptide
  MOD_RES (2)..(5): Any amino acid
DXXXXE

SEQ ID NO: 1660 - protein, 6 aa, Artificial Sequence
  Description of Artificial Sequence: Synthetic peptide
  MOD_RES (2)..(5): Any amino acid
FXXXXY

SEQ ID NO: 1661 - protein, 6 aa, Artificial Sequence
  Description of Artificial Sequence: Synthetic peptide
  MOD_RES (2)..(5): Any amino acid
EXXXXS

SEQ ID NO: 1662 - protein, 6 aa, Artificial Sequence
  Description of Artificial Sequence: Synthetic peptide
  MOD_RES (2)..(5): Any amino acid
NXXXXR

SEQ ID NO: 1663 - protein, 6 aa, Artificial Sequence
  Description of Artificial Sequence: Synthetic peptide
  MOD_RES (2)..(5): Any amino acid
QXXXXL

SEQ ID NO: 1664 - protein, 6 aa, Artificial Sequence
  Description of Artificial Sequence: Synthetic peptide
  MOD_RES (2)..(5): Any amino acid
EXXXXV

SEQ ID NO: 1665 - protein, 6 aa, Artificial Sequence
  Description of Artificial Sequence: Synthetic peptide
  MOD_RES (2)..(5): Any amino acid
VXXXXR

SEQ ID NO: 1666 - protein, 6 aa, Artificial Sequence
  Description of Artificial Sequence: Synthetic peptide
  MOD_RES (2)..(5): Any amino acid
EXXXXK

SEQ ID NO: 1667 - protein, 6 aa, Artificial Sequence
  Description of Artificial Sequence: Synthetic peptide
  MOD_RES (2)..(5): Any amino acid
DXXXXQ

SEQ ID NO: 1668 - protein, 6 aa, Artificial Sequence
  Description of Artificial Sequence: Synthetic peptide
  MOD_RES (2)..(5): Any amino acid
KXXXXY

SEQ ID NO: 1669 - protein, 6 aa, Artificial Sequence
  Description of Artificial Sequence: Synthetic peptide
  MOD_RES (2)..(5): Any amino acid
EXXXXL

SEQ ID NO: 1670 - protein, 6 aa, Artificial Sequence
  Description of Artificial Sequence: Synthetic peptide
  MOD_RES (2)..(5): Any amino acid
CXXXXY

SEQ ID NO: 1671 - protein, 6 aa, Artificial Sequence
  Description of Artificial Sequence: Synthetic peptide
  MOD_RES (2)..(5): Any amino acid
PXXXXR

SEQ ID NO: 1672 - protein, 6 aa, Artificial Sequence
  Description of Artificial Sequence: Synthetic peptide
  MOD_RES (2)..(5): Any amino acid
GXXXXQ

SEQ ID NO: 1673 - protein, 6 aa, Artificial Sequence
  Description of Artificial Sequence: Synthetic peptide
  MOD_RES (2)..(5): Any amino acid
GXXXXQ

SEQ ID NO: 1674 - protein, 6 aa, Artificial Sequence
  Description of Artificial Sequence: Synthetic peptide
  MOD_RES (2)..(5): Any amino acid
NXXXXK

SEQ ID NO: 1675 - protein, 6 aa, Artificial Sequence
  Description of Artificial Sequence: Synthetic peptide
  MOD_RES (2)..(5): Any amino acid
YXXXXH

SEQ ID NO: 1676 - protein, 6 aa, Artificial Sequence
  Description of Artificial Sequence: Synthetic peptide
  MOD_RES (2)..(5): Any amino acid
EXXXXK

SEQ ID NO: 1677 - protein, 6 aa, Artificial Sequence
  Description of Artificial Sequence: Synthetic peptide
  MOD_RES (2)..(5): Any amino acid
LXXXXE

SEQ ID NO: 1678 - protein, 6 aa, Artificial Sequence
  Description of Artificial Sequence: Synthetic peptide
  MOD_RES (2)..(5): Any amino acid
EXXXXR

SEQ ID NO: 1679 - protein, 6 aa, Artificial Sequence
  Description of Artificial Sequence: Synthetic peptide
  MOD_RES (2)..(5): Any amino acid
EXXXXR

SEQ ID NO: 1680 - protein, 6 aa, Artificial Sequence
  Description of Artificial Sequence: Synthetic peptide
  MOD_RES (2)..(5): Any amino acid
IXXXXL

SEQ ID NO: 1681 - protein, 6 aa, Artificial Sequence
  Description of Artificial Sequence: Synthetic peptide
  MOD_RES (2)..(5): Any amino acid
SXXXXQ

SEQ ID NO: 1682 - protein, 6 aa, Artificial Sequence
  Description of Artificial Sequence: Synthetic peptide
  MOD_RES (2)..(5): Any amino acid
KXXXXN

SEQ ID NO: 1683 - protein, 6 aa, Artificial Sequence
  Description of Artificial Sequence: Synthetic peptide
  MOD_RES (2)..(5): Any amino acid
EXXXXR

SEQ ID NO: 1684 - protein, 6 aa, Artificial Sequence
  Description of Artificial Sequence: Synthetic peptide
  MOD_RES (2)..(5): Any amino acid
HXXXXR

SEQ ID NO: 1685 - protein, 6 aa, Artificial Sequence
  Description of Artificial Sequence: Synthetic peptide
  MOD_RES (2)..(5): Any amino acid
MXXXXR

SEQ ID NO: 1686 - protein, 6 aa, Artificial Sequence
  Description of Artificial Sequence: Synthetic peptide
  MOD_RES (2)..(5): Any amino acid
WXXXXK

SEQ ID NO: 1687 - protein, 6 aa, Artificial Sequence
  Description of Artificial Sequence: Synthetic peptide
  MOD_RES (2)..(5): Any amino acid
GXXXXF

SEQ ID NO: 1688 - protein, 6 aa, Artificial Sequence
  Description of Artificial Sequence: Synthetic peptide
  MOD_RES (2)..(5): Any amino acid
VXXXXR

SEQ ID NO: 1689 - protein, 6 aa, Artificial Sequence
  Description of Artificial Sequence: Synthetic peptide
  MOD_RES (2)..(5): Any amino acid
VXXXXF

SEQ ID NO: 1690 - protein, 6 aa, Artificial Sequence
  Description of Artificial Sequence: Synthetic peptide
  MOD_RES (2)..(5): Any amino acid
RXXXXR

SEQ ID NO: 1691 - protein, 6 aa, Artificial Sequence
  Description of Artificial Sequence: Synthetic peptide
  MOD_RES (2)..(5): Any amino acid
SXXXXQ

SEQ ID NO: 1692 - protein, 6 aa, Artificial Sequence
  Description of Artificial Sequence: Synthetic peptide
  MOD_RES (2)..(5): Any amino acid
VXXXXE

SEQ ID NO: 1693 - protein, 6 aa, Artificial Sequence
  Description of Artificial Sequence: Synthetic peptide
  MOD_RES (2)..(5): Any amino acid
GXXXXA

SEQ ID NO: 1694 - protein, 6 aa, Artificial Sequence
  Description of Artificial Sequence: Synthetic peptide
  MOD_RES (2)..(5): Any amino acid
RXXXXE

SEQ ID NO: 1695 - protein, 6 aa, Artificial Sequence
  Description of Artificial Sequence: Synthetic peptide
  MOD_RES (2)..(5): Any amino acid
IXXXXY

SEQ ID NO: 1696 - protein, 6 aa, Artificial Sequence
  Description of Artificial Sequence: Synthetic peptide
  MOD_RES (2)..(5): Any amino acid
YXXXXQ

SEQ ID NO: 1697 - protein, 6 aa, Artificial Sequence
  Description of Artificial Sequence: Synthetic peptide
  MOD_RES (2)..(5): Any amino acid
KXXXXE

SEQ ID NO: 1698 - protein, 6 aa, Artificial Sequence
  Description of Artificial Sequence: Synthetic peptide
  MOD_RES (2)..(5): Any amino acid
RXXXXL

SEQ ID NO: 1699 - protein, 6 aa, Artificial Sequence
  Description of Artificial Sequence: Synthetic peptide
  MOD_RES (2)..(5): Any amino acid
EXXXXY

SEQ ID NO: 1700 - protein, 6 aa, Artificial Sequence
  Description of Artificial Sequence: Synthetic peptide
  MOD_RES (2)..(5): Any amino acid
EXXXXD

SEQ ID NO: 1701 - protein, 6 aa, Artificial Sequence
  Description of Artificial Sequence: Synthetic peptide
  MOD_RES (2)..(5): Any amino acid
QXXXXQ

SEQ ID NO: 1702 - protein, 6 aa, Artificial Sequence
  Description of Artificial Sequence: Synthetic peptide
  MOD_RES (2)..(4): Any amino acid
VXXXNF

SEQ ID NO: 1703 - protein, 6 aa, Artificial Sequence
  Description of Artificial Sequence: Synthetic peptide
  MOD_RES (2)..(4): Any amino acid
TXXXKT

SEQ ID NO: 1704 - protein, 6 aa, Artificial Sequence
  Description of Artificial Sequence: Synthetic peptide
  MOD_RES (2)..(4): Any amino acid
AXXXGV

SEQ ID NO: 1705 - protein, 6 aa, Artificial Sequence
  Description of Artificial Sequence: Synthetic peptide
  MOD_RES (2)..(4): Any amino acid
EXXXMD

SEQ ID NO: 1706 - protein, 6 aa, Artificial Sequence
  Description of Artificial Sequence: Synthetic peptide
  MOD_RES (2)..(4): Any amino acid
GXXXST

SEQ ID NO: 1707 - protein, 6 aa, Artificial Sequence
  Description of Artificial Sequence: Synthetic peptide
  MOD_RES (2)..(4): Any amino acid
GXXXTT

SEQ ID NO: 1708 - protein, 6 aa, Artificial Sequence
  Description of Artificial Sequence: Synthetic peptide
  MOD_RES (2)..(4): Any amino acid
LXXXGK

SEQ ID NO: 1709 - protein, 6 aa, Artificial Sequence
  Description of Artificial Sequence: Synthetic peptide
  MOD_RES (2)..(4): Any amino acid
SXXXDK

SEQ ID NO: 1710 - protein, 6 aa, Artificial Sequence
  Description of Artificial Sequence: Synthetic peptide
  MOD_RES (2)..(4): Any amino acid
PXXXIG

SEQ ID NO: 1711 - protein, 6 aa, Artificial Sequence
  Description of Artificial Sequence: Synthetic peptide
  MOD_RES (2)..(4): Any amino acid
SXXXKS

SEQ ID NO: 1712 - protein, 6 aa, Artificial Sequence
  Description of Artificial Sequence: Synthetic peptide
  MOD_RES (2)..(4): Any amino acid
LXXXVM

SEQ ID NO: 1713 - protein, 6 aa, Artificial Sequence
  Description of Artificial Sequence: Synthetic peptide
  MOD_RES (2)..(4): Any amino acid
VXXXNG

SEQ ID NO: 1714 - protein, 6 aa, Artificial Sequence
  Description of Artificial Sequence: Synthetic peptide
  MOD_RES (2)..(4): Any amino acid
DXXXGK

SEQ ID NO: 1715 - protein, 6 aa, Artificial Sequence
  Description of Artificial Sequence: Synthetic peptide
  MOD_RES (2)..(4): Any amino acid
YXXXNE

SEQ ID NO: 1716 - protein, 6 aa, Artificial Sequence
  Description of Artificial Sequence: Synthetic peptide
  MOD_RES (2)..(4): Any amino acid
DXXXKT

SEQ ID NO: 1717 - protein, 6 aa, Artificial Sequence
  Description of Artificial Sequence: Synthetic peptide
  MOD_RES (2)..(4): Any amino acid
QXXXLG

SEQ ID NO: 1718 - protein, 6 aa, Artificial Sequence
  Description of Artificial Sequence: Synthetic peptide
  MOD_RES (2)..(4): Any amino acid
QXXXWY

SEQ ID NO: 1719 - protein, 6 aa, Artificial Sequence
  Description of Artificial Sequence: Synthetic peptide
  MOD_RES (2)..(4): Any amino acid
YXXXFQ

SEQ ID NO: 1720 - protein, 6 aa, Artificial Sequence
  Description of Artificial Sequence: Synthetic peptide
  MOD_RES (2)..(4): Any amino acid
AXXXGI

SEQ ID NO: 1721 - protein, 6 aa, Artificial Sequence
  Description of Artificial Sequence: Synthetic peptide
  MOD_RES (2)..(4): Any amino acid
CXXXIC

SEQ ID NO: 1722 - protein, 6 aa, Artificial Sequence
  Description of Artificial Sequence: Synthetic peptide
  MOD_RES (2)..(4): Any amino acid
TXXXKK

SEQ ID NO: 1723 - protein, 6 aa, Artificial Sequence
  Description of Artificial Sequence: Synthetic peptide
  MOD_RES (2)..(4): Any amino acid
MXXXDA

SEQ ID NO: 1724 - protein, 6 aa, Artificial Sequence
  Description of Artificial Sequence: Synthetic peptide
  MOD_RES (2)..(4): Any amino acid
QXXXSL

SEQ ID NO: 1725 - protein, 6 aa, Artificial Sequence
  Description of Artificial Sequence: Synthetic peptide
  MOD_RES (2)..(4): Any amino acid
LXXXYH

SEQ ID NO: 1726 - protein, 6 aa, Artificial Sequence
  Description of Artificial Sequence: Synthetic peptide
  MOD_RES (2)..(4): Any amino acid
RXXXPE

SEQ ID NO: 1727 - protein, 6 aa, Artificial Sequence
  Description of Artificial Sequence: Synthetic peptide
  MOD_RES (2)..(4): Any amino acid
QXXXGS

SEQ ID NO: 1728 - protein, 6 aa, Artificial Sequence
  Description of Artificial Sequence: Synthetic peptide
  MOD_RES (2)..(4): Any amino acid
WXXXFT

SEQ ID NO: 1729 - protein, 6 aa, Artificial Sequence
  Description of Artificial Sequence: Synthetic peptide
  MOD_RES (2)..(4): Any amino acid
SXXXGR

SEQ ID NO: 1730 - protein, 6 aa, Artificial Sequence
  Description of Artificial Sequence: Synthetic peptide
  MOD_RES (2)..(4): Any amino acid
NXXXGK

SEQ ID NO: 1731 - protein, 6 aa, Artificial Sequence
  Description of Artificial Sequence: Synthetic peptide
  MOD_RES (2)..(4): Any amino acid
NXXXQF

SEQ ID NO: 1732 - protein, 6 aa, Artificial Sequence
  Description of Artificial Sequence: Synthetic peptide
  MOD_RES (2)..(4): Any amino acid
YXXXRT

SEQ ID NO: 1733 - protein, 6 aa, Artificial Sequence
  Description of Artificial Sequence: Synthetic peptide
  MOD_RES (2)..(4): Any amino acid
SXXXVD

SEQ ID NO: 1734 - protein, 6 aa, Artificial Sequence
  Description of Artificial Sequence: Synthetic peptide
  MOD_RES (2)..(4): Any amino acid
EXXXAE

SEQ ID NO: 1735 - protein, 6 aa, Artificial Sequence
  Description of Artificial Sequence: Synthetic peptide
  MOD_RES (2)..(4): Any amino acid
KXXXLD

SEQ ID NO: 1736 - protein, 6 aa, Artificial Sequence
  Description of Artificial Sequence: Synthetic peptide
  MOD_RES (2)..(4): Any amino acid
KXXXCK

SEQ ID NO: 1737 - protein, 6 aa, Artificial Sequence
  Description of Artificial Sequence: Synthetic peptide
  MOD_RES (2)..(4): Any amino acid
CXXXYR

SEQ ID NO: 1738 - protein, 6 aa, Artificial Sequence
  Description of Artificial Sequence: Synthetic peptide
  MOD_RES (2)..(4): Any amino acid
RXXXGL

SEQ ID NO: 1739 - protein, 6 aa, Artificial Sequence
  Description of Artificial Sequence: Synthetic peptide
  MOD_RES (2)..(4): Any amino acid
QXXXCW

SEQ ID NO: 1740 - protein, 6 aa, Artificial Sequence
  Description of Artificial Sequence: Synthetic peptide
  MOD_RES (2)..(4): Any amino acid
AXXXGK

SEQ ID NO: 1741 - protein, 6 aa, Artificial Sequence
  Description of Artificial Sequence: Synthetic peptide
  MOD_RES (2)..(4): Any amino acid
EXXXAL

SEQ ID NO: 1742 - protein, 6 aa, Artificial Sequence
  Description of Artificial Sequence: Synthetic peptide
  MOD_RES (2)..(4): Any amino acid
PXXXSA

SEQ ID NO: 1743 - protein, 6 aa, Artificial Sequence
  Description of Artificial Sequence: Synthetic peptide
  MOD_RES (2)..(4): Any amino acid
DXXXNG

SEQ ID NO: 1744 - protein, 6 aa, Artificial Sequence
  Description of Artificial Sequence: Synthetic peptide
  MOD_RES (2)..(4): Any amino acid
GXXXSA

SEQ ID NO: 1745 - protein, 6 aa, Artificial Sequence
  Description of Artificial Sequence: Synthetic peptide
  MOD_RES (2)..(4): Any amino acid
RXXXDS

SEQ ID NO: 1746 - protein, 6 aa, Artificial Sequence
  Description of Artificial Sequence: Synthetic peptide
  MOD_RES (2)..(4): Any amino acid
SXXXNT

SEQ ID NO: 1747 - protein, 6 aa, Artificial Sequence
  Description of Artificial Sequence: Synthetic peptide
  MOD_RES (2)..(4): Any amino acid
QXXXGK

SEQ ID NO: 1748 - protein, 6 aa, Artificial Sequence
  Description of Artificial Sequence: Synthetic peptide
  MOD_RES (2)..(4): Any amino acid
RXXXTG

SEQ ID NO: 1749 - protein, 6 aa, Artificial Sequence
  Description of Artificial Sequence: Synthetic peptide
  MOD_RES (2)..(4): Any amino acid
GXXXDF

SEQ ID NO: 1750 - protein, 6 aa, Artificial Sequence
  Description of Artificial Sequence: Synthetic peptide
  MOD_RES (2)..(4): Any amino acid
DXXXGS

SEQ ID NO: 1751 - protein, 6 aa, Artificial Sequence
  Description of Artificial Sequence: Synthetic peptide
  MOD_RES (2)..(4): Any amino acid
CXXXVG

SEQ ID NO: 1752 - protein, 6 aa, Artificial Sequence
  Description of Artificial Sequence: Synthetic peptide
  MOD_RES (2)..(4): Any amino acid
SXXXGC

SEQ ID NO: 1753 - protein, 6 aa, Artificial Sequence
  Description of Artificial Sequence: Synthetic peptide
  MOD_RES (2)..(4): Any amino acid
VXXXCI

SEQ ID NO: 1754 - protein, 6 aa, Artificial Sequence
  Description of Artificial Sequence: Synthetic peptide
  MOD_RES (2)..(4): Any amino acid
EXXXSK

SEQ ID NO: 1755 - protein, 6 aa, Artificial Sequence
  Description of Artificial Sequence: Synthetic peptide
  MOD_RES (2)..(4): Any amino acid
QXXXKT

SEQ ID NO: 1756 - protein, 6 aa, Artificial Sequence
  Description of Artificial Sequence: Synthetic peptide
  MOD_RES (2)..(4): Any amino acid
AXXXGA

SEQ ID NO: 1757 - protein, 6 aa, Artificial Sequence
  Description of Artificial Sequence: Synthetic peptide
  MOD_RES (2)..(4): Any amino acid
WXXXYA

SEQ ID NO: 1758 - protein, 6 aa, Artificial Sequence
  Description of Artificial Sequence: Synthetic peptide
  MOD_RES (2)..(4): Any amino acid
NXXXDK

SEQ ID NO: 1759 - protein, 6 aa, Artificial Sequence
  Description of Artificial Sequence: Synthetic peptide
  MOD_RES (2)..(4): Any amino acid
FXXXLT

SEQ ID NO: 1760 - protein, 6 aa, Artificial Sequence
  Description of Artificial Sequence: Synthetic peptide
  MOD_RES (2)..(4): Any amino acid
AXXXGL

SEQ ID NO: 1761 - protein, 6 aa, Artificial Sequence
  Description of Artificial Sequence: Synthetic peptide
  MOD_RES (2)..(4): Any amino acid
NXXXGG

SEQ ID NO: 1762 - protein, 6 aa, Artificial Sequence
  Description of Artificial Sequence: Synthetic peptide
  MOD_RES (2)..(4): Any amino acid
RXXXTD

SEQ ID NO: 1763 - protein, 6 aa, Artificial Sequence
  Description of Artificial Sequence: Synthetic peptide
  MOD_RES (2)..(4): Any amino acid
KXXXCH

SEQ ID NO: 1764 - protein, 6 aa, Artificial Sequence
  Description of Artificial Sequence: Synthetic peptide
  MOD_RES (2)..(4): Any amino acid
SXXXGR

SEQ ID NO: 1765 - protein, 6 aa, Artificial Sequence
  Description of Artificial Sequence: Synthetic peptide
  MOD_RES (2)..(4): Any amino acid
SXXXCW

SEQ ID NO: 1766 - protein, 6 aa, Artificial Sequence
  Description of Artificial Sequence: Synthetic peptide
  MOD_RES (2)..(4): Any amino acid
RXXXAE

SEQ ID NO: 1767 - protein, 6 aa, Artificial Sequence
  Description of Artificial Sequence: Synthetic peptide
  MOD_RES (2)..(4): Any amino acid
LXXXGV

SEQ ID NO: 1768 - protein, 6 aa, Artificial Sequence
  Description of Artificial Sequence: Synthetic peptide
  MOD_RES (2)..(4): Any amino acid
YXXXNR

SEQ ID NO: 1769 - protein, 6 aa, Artificial Sequence
  Description of Artificial Sequence: Synthetic peptide
  MOD_RES (2)..(4): Any amino acid
PXXXGK

SEQ ID NO: 1770 - protein, 6 aa, Artificial Sequence
  Description of Artificial Sequence: Synthetic peptide
  MOD_RES (2)..(4): Any amino acid
QXXXYG

SEQ ID NO: 1771 - protein, 6 aa, Artificial Sequence
  Description of Artificial Sequence: Synthetic peptide
  MOD_RES (2)..(4): Any amino acid
MXXXKF

SEQ ID NO: 1772 - protein, 6 aa, Artificial Sequence
  Description of Artificial Sequence: Synthetic peptide
  MOD_RES (2)..(4): Any amino acid
PXXXAL

SEQ ID NO: 1773 - protein, 6 aa, Artificial Sequence
  Description of Artificial Sequence: Synthetic peptide
  MOD_RES (2)..(4): Any amino acid
QXXXCH

SEQ ID NO: 1774 - protein, 6 aa, Artificial Sequence
  Description of Artificial Sequence: Synthetic peptide
  MOD_RES (2)..(4): Any amino acid
AXXXNF

SEQ ID NO: 1775 - protein, 6 aa, Artificial Sequence
  Description of Artificial Sequence: Synthetic peptide
  MOD_RES (2)..(4): Any amino acid
NXXXNR

SEQ ID NO: 1776 - protein, 6 aa, Artificial Sequence
  Description of Artificial Sequence: Synthetic peptide
  MOD_RES (2)..(4): Any amino acid
NXXXLM

SEQ ID NO: 1777 - protein, 6 aa, Artificial Sequence
  Description of Artificial Sequence: Synthetic peptide
  MOD_RES (2)..(4): Any amino acid
RXXXGL

SEQ ID NO: 1778 - protein, 6 aa, Artificial Sequence
  Description of Artificial Sequence: Synthetic peptide
  MOD_RES (2)..(4): Any amino acid
NXXXTT

SEQ ID NO: 1779 - protein, 6 aa, Artificial Sequence
  Description of Artificial Sequence: Synthetic peptide
  MOD_RES (2)..(4): Any amino acid
KXXXQK

SEQ ID NO: 1780 - protein, 6 aa, Artificial Sequence
  Description of Artificial Sequence: Synthetic peptide
  MOD_RES (2)..(4): Any amino acid
KXXXGK

SEQ ID NO: 1781 - protein, 6 aa, Artificial Sequence
  Description of Artificial Sequence: Synthetic peptide
  MOD_RES (2)..(4): Any amino acid
RXXXGL

SEQ ID NO: 1782 - protein, 6 aa, Artificial Sequence
  Description of Artificial Sequence: Synthetic peptide
  MOD_RES (2)..(4): Any amino acid
EXXXAQ

SEQ ID NO: 1783 - protein, 6 aa, Artificial Sequence
  Description of Artificial Sequence: Synthetic peptide
  MOD_RES (2)..(4): Any amino acid
RXXXGK

SEQ ID NO: 1784 - protein, 6 aa, Artificial Sequence
  Description of Artificial Sequence: Synthetic peptide
  MOD_RES (2)..(4): Any amino acid
EXXXSR

SEQ ID NO: 1785 - protein, 6 aa, Artificial Sequence
  Description of Artificial Sequence: Synthetic peptide
  MOD_RES (2)..(4): Any amino acid
MXXXRN

SEQ ID NO: 1786 - protein, 6 aa, Artificial Sequence
  Description of Artificial Sequence: Synthetic peptide
  MOD_RES (2)..(4): Any amino acid
GXXXAH

SEQ ID NO: 1787 - protein, 6 aa, Artificial Sequence
  Description of Artificial Sequence: Synthetic peptide
  MOD_RES (2)..(4): Any amino acid
HXXXGK

SEQ ID NO: 1788 - protein, 6 aa, Artificial Sequence
  Description of Artificial Sequence: Synthetic peptide
  MOD_RES (2)..(4): Any amino acid
NXXXSR

SEQ ID NO: 1789 - protein, 6 aa, Artificial Sequence
  Description of Artificial Sequence: Synthetic peptide
  MOD_RES (2)..(4): Any amino acid
AXXXQK

SEQ ID NO: 1790 - protein, 6 aa, Artificial Sequence
  Description of Artificial Sequence: Synthetic peptide
  MOD_RES (2)..(4): Any amino acid
QXXXGI

SEQ ID NO: 1791 - protein, 6 aa, Artificial Sequence
  Description of Artificial Sequence: Synthetic peptide
  MOD_RES (2)..(4): Any amino acid
CXXXIG

SEQ ID NO: 1792 - protein, 6 aa, Artificial Sequence
  Description of Artificial Sequence: Synthetic peptide
  MOD_RES (2)..(4): Any amino acid
EXXXSK

SEQ ID NO: 1793 - protein, 6 aa, Artificial Sequence
  Description of Artificial Sequence: Synthetic peptide
  MOD_RES (2)..(4): Any amino acid
SXXXSL

SEQ ID NO: 1794 - protein, 6 aa, Artificial Sequence
  Description of Artificial Sequence: Synthetic peptide
  MOD_RES (2)..(4): Any amino acid
GXXXKT

SEQ ID NO: 1795 - protein, 6 aa, Artificial Sequence
  Description of Artificial Sequence: Synthetic peptide
  MOD_RES (2)..(4): Any amino acid
RXXXQR

SEQ ID NO: 1796 - protein, 6 aa, Artificial Sequence
  Description of Artificial Sequence: Synthetic peptide
  MOD_RES (2)..(4): Any amino acid
KXXXPG

SEQ ID NO: 1797 - protein, 6 aa, Artificial Sequence
  Description of Artificial Sequence: Synthetic peptide
  MOD_RES (2)..(4): Any amino acid
AXXXCH

SEQ ID NO: 1798 - protein, 6 aa, Artificial Sequence
  Description of Artificial Sequence: Synthetic peptide
  MOD_RES (2)..(4): Any amino acid
RXXXGG

SEQ ID NO: 1799 - protein, 6 aa, Artificial Sequence
  Description of Artificial Sequence: Synthetic peptide
  MOD_RES (2)..(4): Any amino acid
AXXXRH

SEQ ID NO: 1800 - protein, 6 aa, Artificial Sequence
  Description of Artificial Sequence: Synthetic peptide
  MOD_RES (2)..(4): Any amino acid
CXXXIG

SEQ ID NO: 1801 - protein, 6 aa, Artificial Sequence
  Description of Artificial Sequence: Synthetic peptide
  MOD_RES (2)..(3): Any amino acid
  MOD_RES (5)..(5): Any amino acid
GXXKXT

SEQ ID NO: 1802 - protein, 6 aa, Artificial Sequence
  Description of Artificial Sequence: Synthetic peptide
  MOD_RES (2)..(3): Any amino acid
  MOD_RES (5)..(5): Any amino acid
TXXGXT

SEQ ID NO: 1803 - protein, 6 aa, Artificial Sequence
  Description of Artificial Sequence: Synthetic peptide
  MOD_RES (2)..(3): Any amino acid
  MOD_RES (5)..(5): Any amino acid
VXXKXG

SEQ ID NO: 1804 - protein, 6 aa, Artificial Sequence
  Description of Artificial Sequence: Synthetic peptide
  MOD_RES (2)..(3): Any amino acid
  MOD_RES (5)..(5): Any amino acid
SXXVXK

SEQ ID NO: 1805 - protein, 6 aa, Artificial Sequence
  Description of Artificial Sequence: Synthetic peptide
  MOD_RES (2)..(3): Any amino acid
  MOD_RES (5)..(5): Any amino acid
QXXGXG

SEQ ID NO: 1806 - protein, 6 aa, Artificial Sequence
  Description of Artificial Sequence: Synthetic peptide
  MOD_RES (2)..(3): Any amino acid
  MOD_RES (5)..(5): Any amino acid
DXXGXG

SEQ ID NO: 1807 - protein, 6 aa, Artificial Sequence
  Description of Artificial Sequence: Synthetic peptide
  MOD_RES (2)..(3): Any amino acid
  MOD_RES (5)..(5): Any amino acid
CXXGXT

SEQ ID NO: 1808 - protein, 6 aa, Artificial Sequence
  Description of Artificial Sequence: Synthetic peptide
  MOD_RES (2)..(3): Any amino acid
  MOD_RES (5)..(5): Any amino acid
RXXDXD

SEQ ID NO: 1809 - protein, 6 aa, Artificial Sequence
  Description of Artificial Sequence: Synthetic peptide
  MOD_RES (2)..(3): Any amino acid
  MOD_RES (5)..(5): Any amino acid
DXXGXT

SEQ ID NO: 1810 - protein, 6 aa, Artificial Sequence
  Description of Artificial Sequence: Synthetic peptide
  MOD_RES (2)..(3): Any amino acid
  MOD_RES (5)..(5): Any amino acid
PXXLXV

SEQ ID NO: 1811 - protein, 6 aa, Artificial Sequence
  Description of Artificial Sequence: Synthetic peptide
  MOD_RES (2)..(3): Any amino acid
  MOD_RES (5)..(5): Any amino acid
TXXDXK

SEQ ID NO: 1812 - protein, 6 aa, Artificial Sequence
  Description of Artificial Sequence: Synthetic peptide
  MOD_RES (2)..(3): Any amino acid
  MOD_RES (5)..(5): Any amino acid
PXXNXG

SEQ ID NO: 1813 - protein, 6 aa, Artificial Sequence
  Description of Artificial Sequence: Synthetic peptide
  MOD_RES (2)..(3): Any amino acid
  MOD_RES (5)..(5): Any amino acid
DXXVXK

SEQ ID NO: 1814 - protein, 6 aa, Artificial Sequence
  Description of Artificial Sequence: Synthetic peptide
  MOD_RES (2)..(3): Any amino acid
  MOD_RES (5)..(5): Any amino acid
LXXLXT

SEQ ID NO: 1815 - protein, 6 aa, Artificial Sequence
  Description of Artificial Sequence: Synthetic peptide
  MOD_RES (2)..(3): Any amino acid
  MOD_RES (5)..(5): Any amino acid
FXXHXA

SEQ ID NO: 1816 - protein, 6 aa, Artificial Sequence
  Description of Artificial Sequence: Synthetic peptide
  MOD_RES (2)..(3): Any amino acid
  MOD_RES (5)..(5): Any amino acid
RXXGXG

SEQ ID NO: 1817 - protein, 6 aa, Artificial Sequence
  Description of Artificial Sequence: Synthetic peptide
  MOD_RES (2)..(3): Any amino acid
  MOD_RES (5)..(5): Any amino acid
LXXNXM

SEQ ID NO: 1818 - protein, 6 aa, Artificial Sequence
  Description of Artificial Sequence: Synthetic peptide
  MOD_RES (2)..(3): Any amino acid
  MOD_RES (5)..(5): Any amino acid
SXXGXT

SEQ ID NO: 1819 - protein, 6 aa, Artificial Sequence
  Description of Artificial Sequence: Synthetic peptide
  MOD_RES (2)..(3): Any amino acid
  MOD_RES (5)..(5): Any amino acid
NXXKXT

SEQ ID NO: 1820 - protein, 6 aa, Artificial Sequence
  Description of Artificial Sequence: Synthetic peptide
  MOD_RES (2)..(3): Any amino acid
  MOD_RES (5)..(5): Any amino acid
SXXKXD

SEQ ID NO: 1821 - protein, 6 aa, Artificial Sequence
  Description of Artificial Sequence: Synthetic peptide
  MOD_RES (2)..(3): Any amino acid
  MOD_RES (5)..(5): Any amino acid
YXXGXT

SEQ ID NO: 1822 - protein, 6 aa, Artificial Sequence
  Description of Artificial Sequence: Synthetic peptide
  MOD_RES (2)..(3): Any amino acid
  MOD_RES (5)..(5): Any amino acid
CXXGXG

SEQ ID NO: 1823 - protein, 6 aa, Artificial Sequence
  Description of Artificial Sequence: Synthetic peptide
  MOD_RES (2)..(3): Any amino acid
  MOD_RES (5)..(5): Any amino acid
DXXGXP

SEQ ID NO: 1824 - protein, 6 aa, Artificial Sequence
  Description of Artificial Sequence: Synthetic peptide
  MOD_RES (2)..(3): Any amino acid
  MOD_RES (5)..(5): Any amino acid
LXXKXY

SEQ ID NO: 1825 - protein, 6 aa, Artificial Sequence
  Description of Artificial Sequence: Synthetic peptide
  MOD_RES (2)..(3): Any amino acid
  MOD_RES (5)..(5): Any amino acid
GXXKXS

SEQ ID NO: 1826 - protein, 6 aa, Artificial Sequence
  Description of Artificial Sequence: Synthetic peptide
  MOD_RES (2)..(3): Any amino acid
  MOD_RES (5)..(5): Any amino acid
EXXGXS

SEQ ID NO: 1827 - protein, 6 aa, Artificial Sequence
  Description of Artificial Sequence: Synthetic peptide
  MOD_RES (2)..(3): Any amino acid
  MOD_RES (5)..(5): Any amino acid
KXXFXV

SEQ ID NO: 1828 - protein, 6 aa, Artificial Sequence
  Description of Artificial Sequence: Synthetic peptide
  MOD_RES (2)..(3): Any amino acid
  MOD_RES (5)..(5): Any amino acid
LXXAXK

SEQ ID NO: 1829 - protein, 6 aa, Artificial Sequence
  Description of Artificial Sequence: Synthetic peptide
  MOD_RES (2)..(3): Any amino acid
  MOD_RES (5)..(5): Any amino acid
RXXMXS

SEQ ID NO: 1830 - protein, 6 aa, Artificial Sequence
  Description of Artificial Sequence: Synthetic peptide
  MOD_RES (2)..(3): Any amino acid
  MOD_RES (5)..(5): Any amino acid
MXXFXF

SEQ ID NO: 1831 - protein, 6 aa, Artificial Sequence
  Description of Artificial Sequence: Synthetic peptide
  MOD_RES (2)..(3): Any amino acid
  MOD_RES (5)..(5): Any amino acid
MXXCXL

SEQ ID NO: 1832 - protein, 6 aa, Artificial Sequence
  Description of Artificial Sequence: Synthetic peptide
  MOD_RES (2)..(3): Any amino acid
  MOD_RES (5)..(5): Any amino acid
YXXNXQ

SEQ ID NO: 1833 - protein, 6 aa, Artificial Sequence
  Description of Artificial Sequence: Synthetic peptide
  MOD_RES (2)..(3): Any amino acid
  MOD_RES (5)..(5): Any amino acid
KXXGXD

SEQ ID NO: 1834 - protein, 6 aa, Artificial Sequence
  Description of Artificial Sequence: Synthetic peptide
  MOD_RES (2)..(3): Any amino acid
  MOD_RES (5)..(5): Any amino acid
AXXGXP

SEQ ID NO: 1835 - protein, 6 aa, Artificial Sequence
  Description of Artificial Sequence: Synthetic peptide
  MOD_RES (2)..(3): Any amino acid
  MOD_RES (5)..(5): Any amino acid
KXXGXN

SEQ ID NO: 1836 - protein, 6 aa, Artificial Sequence
  Description of Artificial Sequence: Synthetic peptide
  MOD_RES (2)..(3): Any amino acid
  MOD_RES (5)..(5): Any amino acid
SXXGXS

SEQ ID NO: 1837 - protein, 6 aa, Artificial Sequence
  Description of Artificial Sequence: Synthetic peptide
  MOD_RES (2)..(3): Any amino acid
  MOD_RES (5)..(5): Any amino acid
NXXCXN

SEQ ID NO: 1838 - protein, 6 aa, Artificial Sequence
  Description of Artificial Sequence: Synthetic peptide
  MOD_RES (2)..(3): Any amino acid
  MOD_RES (5)..(5): Any amino acid
AXXKXT

SEQ ID NO: 1839 - protein, 6 aa, Artificial Sequence
  Description of Artificial Sequence: Synthetic peptide
  MOD_RES (2)..(3): Any amino acid
  MOD_RES (5)..(5): Any amino acid
GXXGXC

SEQ ID NO: 1840 - protein, 6 aa, Artificial Sequence
  Description of Artificial Sequence: Synthetic peptide
  MOD_RES (2)..(3): Any amino acid
  MOD_RES (5)..(5): Any amino acid
SXXAXW

SEQ ID NO: 1841 - protein, 6 aa, Artificial Sequence
  Description of Artificial Sequence: Synthetic peptide
  MOD_RES (2)..(3): Any amino acid
  MOD_RES (5)..(5): Any amino acid
KXXGXP

SEQ ID NO: 1842 - protein, 6 aa, Artificial Sequence
  Description of Artificial Sequence: Synthetic peptide
  MOD_RES (2)..(3): Any amino acid
  MOD_RES (5)..(5): Any amino acid
RXXGXA

SEQ ID NO: 1843 - protein, 6 aa, Artificial Sequence
  Description of Artificial Sequence: Synthetic peptide
  MOD_RES (2)..(3): Any amino acid
  MOD_RES (5)..(5): Any amino acid
RXXDXS

SEQ ID NO: 1844 - protein, 6 aa, Artificial Sequence
  Description of Artificial Sequence: Synthetic peptide
  MOD_RES (2)..(3): Any amino acid
  MOD_RES (5)..(5): Any amino acid
EXXPXD

SEQ ID NO: 1845 - protein, 6 aa, Artificial Sequence
  Description of Artificial Sequence: Synthetic peptide
  MOD_RES (2)..(3): Any amino acid
  MOD_RES (5)..(5): Any amino acid
RXXGXP

SEQ ID NO: 1846 - protein, 6 aa, Artificial Sequence
  Description of Artificial Sequence: Synthetic peptide
  MOD_RES (2)..(3): Any amino acid
  MOD_RES (5)..(5): Any amino acid
NXXGXS

SEQ ID NO: 1847 - protein, 6 aa, Artificial Sequence
  Description of Artificial Sequence: Synthetic peptide
  MOD_RES (2)..(3): Any amino acid
  MOD_RES (5)..(5): Any amino acid
EXXGXS

SEQ ID NO: 1848 - protein, 6 aa, Artificial Sequence
  Description of Artificial Sequence: Synthetic peptide
  MOD_RES (2)..(3): Any amino acid
  MOD_RES (5)..(5): Any amino acid
SXXWXS

SEQ ID NO: 1849 - protein, 6 aa, Artificial Sequence
  Description of Artificial Sequence: Synthetic peptide
  MOD_RES (2)..(3): Any amino acid
  MOD_RES (5)..(5): Any amino acid
RXXGXN

SEQ ID NO: 1850 - protein, 6 aa, Artificial Sequence
  Description of Artificial Sequence: Synthetic peptide
  MOD_RES (2)..(3): Any amino acid
  MOD_RES (5)..(5): Any amino acid
SXXIXR

SEQ ID NO: 1851 - protein, 6 aa, Artificial Sequence
  Description of Artificial Sequence: Synthetic peptide
  MOD_RES (2)..(3): Any amino acid
  MOD_RES (5)..(5): Any amino acid
GXXFXI

SEQ ID NO: 1852 - protein, 6 aa, Artificial Sequence
  Description of Artificial Sequence: Synthetic peptide
  MOD_RES (2)..(3): Any amino acid
  MOD_RES (5)..(5): Any amino acid
NXXVXK

SEQ ID NO: 1853 - protein, 6 aa, Artificial Sequence
  Description of Artificial Sequence: Synthetic peptide
  MOD_RES (2)..(3): Any amino acid
  MOD_RES (5)..(5): Any amino acid
TXXLXK

SEQ ID NO: 1854 - protein, 6 aa, Artificial Sequence
  Description of Artificial Sequence: Synthetic peptide
  MOD_RES (2)..(3): Any amino acid
  MOD_RES (5)..(5): Any amino acid
EXXGXP

SEQ ID NO: 1855 - protein, 6 aa, Artificial Sequence
  Description of Artificial Sequence: Synthetic peptide
  MOD_RES (2)..(3): Any amino acid
  MOD_RES (5)..(5): Any amino acid
MXXSXN

SEQ ID NO: 1856 - protein, 6 aa, Artificial Sequence
  Description of Artificial Sequence: Synthetic peptide
  MOD_RES (2)..(3): Any amino acid
  MOD_RES (5)..(5): Any amino acid
CXXNXC

SEQ ID NO: 1857 - protein, 6 aa, Artificial Sequence
  Description of Artificial Sequence: Synthetic peptide
  MOD_RES (2)..(3): Any amino acid
  MOD_RES (5)..(5): Any amino acid
KXXGXN

SEQ ID NO: 1858 - protein, 6 aa, Artificial Sequence
  Description of Artificial Sequence: Synthetic peptide
  MOD_RES (2)..(3): Any amino acid
  MOD_RES (5)..(5): Any amino acid
SXXIXR

SEQ ID NO: 1859 - protein, 6 aa, Artificial Sequence
  Description of Artificial Sequence: Synthetic peptide
  MOD_RES (2)..(3): Any amino acid
  MOD_RES (5)..(5): Any amino acid
EXXLXY

SEQ ID NO: 1860 - protein, 6 aa, Artificial Sequence
  Description of Artificial Sequence: Synthetic peptide
  MOD_RES (2)..(3): Any amino acid
  MOD_RES (5)..(5): Any amino acid
GXXKXA

SEQ ID NO: 1861 - protein, 6 aa, Artificial Sequence
  Description of Artificial Sequence: Synthetic peptide
  MOD_RES (2)..(3): Any amino acid
  MOD_RES (5)..(5): Any amino acid
RXXTXK

SEQ ID NO: 1862 - protein, 6 aa, Artificial Sequence
  Description of Artificial Sequence: Synthetic peptide
  MOD_RES (2)..(3): Any amino acid
  MOD_RES (5)..(5): Any amino acid
SXXTXC

SEQ ID NO: 1863 - protein, 6 aa, Artificial Sequence
  Description of Artificial Sequence: Synthetic peptide
  MOD_RES (2)..(3): Any amino acid
  MOD_RES (5)..(5): Any amino acid
RXXGXV

SEQ ID NO: 1864 - protein, 6 aa, Artificial Sequence
  Description of Artificial Sequence: Synthetic peptide
  MOD_RES (2)..(3): Any amino acid
  MOD_RES (5)..(5): Any amino acid
EXXGXV

SEQ ID NO: 1865 - protein, 6 aa, Artificial Sequence
  Description of Artificial Sequence: Synthetic peptide
  MOD_RES (2)..(3): Any amino acid
  MOD_RES (5)..(5): Any amino acid
AXXGXA

SEQ ID NO: 1866 - protein, 6 aa, Artificial Sequence
  Description of Artificial Sequence: Synthetic peptide
  MOD_RES (2)..(3): Any amino acid
  MOD_RES (5)..(5): Any amino acid
TXXGXT

SEQ ID NO: 1867 - protein, 6 aa, Artificial Sequence
  Description of Artificial Sequence: Synthetic peptide
  MOD_RES (2)..(3): Any amino acid
  MOD_RES (5)..(5): Any amino acid
QXXTXK

SEQ ID NO: 1868 - protein, 6 aa, Artificial Sequence
  Description of Artificial Sequence: Synthetic peptide
  MOD_RES (2)..(3): Any amino acid
  MOD_RES (5)..(5): Any amino acid
PXXSXK

SEQ ID NO: 1869 - protein, 6 aa, Artificial Sequence
  Description of Artificial Sequence: Synthetic peptide
  MOD_RES (2)..(3): Any amino acid
  MOD_RES (5)..(5): Any amino acid
NXXPXR

SEQ ID NO: 1870 - protein, 6 aa, Artificial Sequence
  Description of Artificial Sequence: Synthetic peptide
  MOD_RES (2)..(3): Any amino acid
  MOD_RES (5)..(5): Any amino acid
DXXTXT

SEQ ID NO: 1871 - protein, 6 aa, Artificial Sequence
  Description of Artificial Sequence: Synthetic peptide
  MOD_RES (2)..(3): Any amino acid
  MOD_RES (5)..(5): Any amino acid
PXXGXS

SEQ ID NO: 1872 - protein, 6 aa, Artificial Sequence
  Description of Artificial Sequence: Synthetic peptide
  MOD_RES (2)..(3): Any amino acid
  MOD_RES (5)..(5): Any amino acid
EXXGXL

SEQ ID NO: 1873 - protein, 6 aa, Artificial Sequence
  Description of Artificial Sequence: Synthetic peptide
  MOD_RES (2)..(3): Any amino acid
  MOD_RES (5)..(5): Any amino acid
AXXGXS

SEQ ID NO: 1874 - protein, 6 aa, Artificial Sequence
  Description of Artificial Sequence: Synthetic peptide
  MOD_RES (2)..(3): Any amino acid
  MOD_RES (5)..(5): Any amino acid
QXXCXS

SEQ ID NO: 1875 - protein, 6 aa, Artificial Sequence
  Description of Artificial Sequence: Synthetic peptide
  MOD_RES (2)..(3): Any amino acid
  MOD_RES (5)..(5): Any amino acid
LXXSXK

SEQ ID NO: 1876 - protein, 6 aa, Artificial Sequence
  Description of Artificial Sequence: Synthetic peptide
  MOD_RES (2)..(3): Any amino acid
  MOD_RES (5)..(5): Any amino acid
FXXAXN

SEQ ID NO: 1877 - protein, 6 aa, Artificial Sequence
  Description of Artificial Sequence: Synthetic peptide
  MOD_RES (2)..(3): Any amino acid
  MOD_RES (5)..(5): Any amino acid
RXXGXE

SEQ ID NO: 1878 - protein, 6 aa, Artificial Sequence
  Description of Artificial Sequence: Synthetic peptide
  MOD_RES (2)..(3): Any amino acid
  MOD_RES (5)..(5): Any amino acid
AXXGXP

SEQ ID NO: 1879 - protein, 6 aa, Artificial Sequence
  Description of Artificial Sequence: Synthetic peptide
  MOD_RES (2)..(3): Any amino acid
  MOD_RES (5)..(5): Any amino acid
NXXDXD

SEQ ID NO: 1880 - protein, 6 aa, Artificial Sequence
  Description of Artificial Sequence: Synthetic peptide
  MOD_RES (2)..(3): Any amino acid
  MOD_RES (5)..(5): Any amino acid
RXXGXP

SEQ ID NO: 1881 - protein, 6 aa, Artificial Sequence
  Description of Artificial Sequence: Synthetic peptide
  MOD_RES (2)..(3): Any amino acid
  MOD_RES (5)..(5): Any amino acid
CXXGXM

SEQ ID NO: 1882 - protein, 6 aa, Artificial Sequence
  Description of Artificial Sequence: Synthetic peptide
  MOD_RES (2)..(3): Any amino acid
  MOD_RES (5)..(5): Any amino acid
LXXGXR

SEQ ID NO: 1883 - protein, 6 aa, Artificial Sequence
  Description of Artificial Sequence: Synthetic peptide
  MOD_RES (2)..(3): Any amino acid
  MOD_RES (5)..(5): Any amino acid
DXXEXG

SEQ ID NO: 1884 - protein, 6 aa, Artificial Sequence
  Description of Artificial Sequence: Synthetic peptide
  MOD_RES (2)..(3): Any amino acid
  MOD_RES (5)..(5): Any amino acid
QXXSXW

SEQ ID NO: 1885 - protein, 6 aa, Artificial Sequence
  Description of Artificial Sequence: Synthetic peptide
  MOD_RES (2)..(3): Any amino acid
  MOD_RES (5)..(5): Any amino acid
IXXGXL

SEQ ID NO: 1886 - protein, 6 aa, Artificial Sequence
  Description of Artificial Sequence: Synthetic peptide
  MOD_RES (2)..(3): Any amino acid
  MOD_RES (5)..(5): Any amino acid
FXXMXR

SEQ ID NO: 1887 - protein, 6 aa, Artificial Sequence
  Description of Artificial Sequence: Synthetic peptide
  MOD_RES (2)..(3): Any amino acid
  MOD_RES (5)..(5): Any amino acid
LXXAXK

SEQ ID NO: 1888 - protein, 6 aa, Artificial Sequence
  Description of Artificial Sequence: Synthetic peptide
  MOD_RES (2)..(3): Any amino acid
  MOD_RES (5)..(5): Any amino acid
LXXPXY

SEQ ID NO: 1889 - protein, 6 aa, Artificial Sequence
  Description of Artificial Sequence: Synthetic peptide
  MOD_RES (2)..(3): Any amino acid
  MOD_RES (5)..(5): Any amino acid
EXXGXW

SEQ ID NO: 1890 - protein, 6 aa, Artificial Sequence
  Description of Artificial Sequence: Synthetic peptide
  MOD_RES (2)..(3): Any amino acid
  MOD_RES (5)..(5): Any amino acid
NXXCXS

SEQ ID NO: 1891 - protein, 6 aa, Artificial Sequence
  Description of Artificial Sequence: Synthetic peptide
  MOD_RES (2)..(3): Any amino acid
  MOD_RES (5)..(5): Any amino acid
GXXPXW

SEQ ID NO: 1892 - protein, 6 aa, Artificial Sequence
  Description of Artificial Sequence: Synthetic peptide
  MOD_RES (2)..(3): Any amino acid
  MOD_RES (5)..(5): Any amino acid
RXXGXS

SEQ ID NO: 1893 - protein, 6 aa, Artificial Sequence
  Description of Artificial Sequence: Synthetic peptide
  MOD_RES (2)..(3): Any amino acid
  MOD_RES (5)..(5): Any amino acid
AXXGXT

SEQ ID NO: 1894 - protein, 6 aa, Artificial Sequence
  Description of Artificial Sequence: Synthetic peptide
  MOD_RES (2)..(3): Any amino acid
  MOD_RES (5)..(5): Any amino acid
DXXEXL

SEQ ID NO: 1895 - protein, 6 aa, Artificial Sequence
  Description of Artificial Sequence: Synthetic peptide
  MOD_RES (2)..(3): Any amino acid
  MOD_RES (5)..(5): Any amino acid
EXXGXE

SEQ ID NO: 1896 - protein, 6 aa, Artificial Sequence
  Description of Artificial Sequence: Synthetic peptide
  MOD_RES (2)..(3): Any amino acid
  MOD_RES (5)..(5): Any amino acid
KXXHXY

SEQ ID NO: 1897 - protein, 6 aa, Artificial Sequence
  Description of Artificial Sequence: Synthetic peptide
  MOD_RES (2)..(3): Any amino acid
  MOD_RES (5)..(5): Any amino acid
PXXSXE

SEQ ID NO: 1898 - protein, 6 aa, Artificial Sequence
  Description of Artificial Sequence: Synthetic peptide
  MOD_RES (2)..(3): Any amino acid
  MOD_RES (5)..(5): Any amino acid
GXXTXY

SEQ ID NO: 1899 - protein, 6 aa, Artificial Sequence
  Description of Artificial Sequence: Synthetic peptide
  MOD_RES (2)..(3): Any amino acid
  MOD_RES (5)..(5): Any amino acid
EXXGXR

SEQ ID NO: 1900 - protein, 6 aa, Artificial Sequence
  Description of Artificial Sequence: Synthetic peptide
  MOD_RES (2)..(3): Any amino acid
TXXGKT

SEQ ID NO: 1901 - protein, 6 aa, Artificial Sequence
  Description of Artificial Sequence: Synthetic peptide
  MOD_RES (2)..(3): Any amino acid
SXXVDK

SEQ ID NO: 1902 - protein, 6 aa, Artificial Sequence
  Description of Artificial Sequence: Synthetic peptide
  MOD_RES (2)..(3): Any amino acid
DXXGKT

SEQ ID NO: 1903 - protein, 6 aa, Artificial Sequence
  Description of Artificial Sequence: Synthetic peptide
  MOD_RES (2)..(3): Any amino acid
TXXDKK

SEQ ID NO: 1904 - protein, 6 aa, Artificial Sequence
  Description of Artificial Sequence: Synthetic peptide
  MOD_RES (2)..(3): Any amino acid
GXXKTT

SEQ ID NO: 1905 - protein, 6 aa, Artificial Sequence
  Description of Artificial Sequence: Synthetic peptide
  MOD_RES (2)..(3): Any amino acid
YXXNFQ

SEQ ID NO: 1906 - protein, 6 aa, Artificial Sequence
  Description of Artificial Sequence: Synthetic peptide
  MOD_RES (2)..(3): Any amino acid
GXXKST

SEQ ID NO: 1907 - protein, 6 aa, Artificial Sequence
  Description of Artificial Sequence: Synthetic peptide
  MOD_RES (2)..(3): Any amino acid
QXXGLG

SEQ ID NO: 1908 - protein, 6 aa, Artificial Sequence
  Description of Artificial Sequence: Synthetic peptide
  MOD_RES (2)..(3): Any amino acid
DXXVGK

SEQ ID NO: 1909 - protein, 6 aa, Artificial Sequence
  Description of Artificial Sequence: Synthetic peptide
  MOD_RES (2)..(3): Any amino acid
LXXAGK

SEQ ID NO: 1910 - protein, 6 aa, Artificial Sequence
  Description of Artificial Sequence: Synthetic peptide
  MOD_RES (2)..(3): Any amino acid
SXXKVD

SEQ ID NO: 1911 - protein, 6 aa, Artificial Sequence
  Description of Artificial Sequence: Synthetic peptide
  MOD_RES (2)..(3): Any amino acid
SXXIGR

SEQ ID NO: 1912 - protein, 6 aa, Artificial Sequence
  Description of Artificial Sequence: Synthetic peptide
  MOD_RES (2)..(3): Any amino acid
SXXGKS

SEQ ID NO: 1913 - protein, 6 aa, Artificial Sequence
  Description of Artificial Sequence: Synthetic peptide
  MOD_RES (2)..(3): Any amino acid
SXXGNT

SEQ ID NO: 1914 - protein, 6 aa, Artificial Sequence
  Description of Artificial Sequence: Synthetic peptide
  MOD_RES (2)..(3): Any amino acid
LXXNVM

SEQ ID NO: 1915 - protein, 6 aa, Artificial Sequence
  Description of Artificial Sequence: Synthetic peptide
  MOD_RES (2)..(3): Any amino acid
RXXMDS

SEQ ID NO: 1916 - protein, 6 aa, Artificial Sequence
  Description of Artificial Sequence: Synthetic peptide
  MOD_RES (2)..(3): Any amino acid
CXXNIC

SEQ ID NO: 1917 - protein, 6 aa, Artificial Sequence
  Description of Artificial Sequence: Synthetic peptide
  MOD_RES (2)..(3): Any amino acid
NXXKTT

SEQ ID NO: 1918 - protein, 6 aa, Artificial Sequence
  Description of Artificial Sequence: Synthetic peptide
  MOD_RES (2)..(3): Any amino acid
PXXNIG

SEQ ID NO: 1919 - protein, 6 aa, Artificial Sequence
  Description of Artificial Sequence: Synthetic peptide
  MOD_RES (2)..(3): Any amino acid
DXXGDG

SEQ ID NO: 1920 - protein, 6 aa, Artificial Sequence
  Description of Artificial Sequence: Synthetic peptide
  MOD_RES (2)..(3): Any amino acid
VXXKNG

SEQ ID NO: 1921 - protein, 6 aa, Artificial Sequence
  Description of Artificial Sequence: Synthetic peptide
  MOD_RES (2)..(3): Any amino acid
CXXGIG

SEQ ID NO: 1922 - protein, 6 aa, Artificial Sequence
  Description of Artificial Sequence: Synthetic peptide
  MOD_RES (2)..(3): Any amino acid
YXXGRT

SEQ ID NO: 1923 - protein, 6 aa, Artificial Sequence
  Description of Artificial Sequence: Synthetic peptide
  MOD_RES (2)..(3): Any amino acid
SXXIGR

SEQ ID NO: 1924 - protein, 6 aa, Artificial Sequence
  Description of Artificial Sequence: Synthetic peptide
  MOD_RES (2)..(3): Any amino acid
NXXVDK

SEQ ID NO: 1925 - protein, 6 aa, Artificial Sequence
  Description of Artificial Sequence: Synthetic peptide
  MOD_RES (2)..(3): Any amino acid
SXXVGR

SEQ ID NO: 1926 - protein, 6 aa, Artificial Sequence
  Description of Artificial Sequence: Synthetic peptide
  MOD_RES (2)..(3): Any amino acid
NXXVDN

SEQ ID NO: 1927 - protein, 6 aa, Artificial Sequence
  Description of Artificial Sequence: Synthetic peptide
  MOD_RES (2)..(3): Any amino acid
QXXFHI

SEQ ID NO: 1928 - protein, 6 aa, Artificial Sequence
  Description of Artificial Sequence: Synthetic peptide
  MOD_RES (2)..(3): Any amino acid
YXXIHA

SEQ ID NO: 1929 - protein, 6 aa, Artificial Sequence
  Description of Artificial Sequence: Synthetic peptide
  MOD_RES (2)..(3): Any amino acid
DXXRFV

SEQ ID NO: 1930 - protein, 6 aa, Artificial Sequence
  Description of Artificial Sequence: Synthetic peptide
  MOD_RES (2)..(3): Any amino acid
TXXVFE

SEQ ID NO: 1931 - protein, 6 aa, Artificial Sequence
  Description of Artificial Sequence: Synthetic peptide
  MOD_RES (2)..(3): Any amino acid
GXXDNG

SEQ ID NO: 1932 - protein, 6 aa, Artificial Sequence
  Description of Artificial Sequence: Synthetic peptide
  MOD_RES (2)..(3): Any amino acid
DXXGNG

SEQ ID NO: 1933 - protein, 6 aa, Artificial Sequence
  Description of Artificial Sequence: Synthetic peptide
  MOD_RES (2)..(3): Any amino acid
AXXVGK

SEQ ID NO: 1934 - protein, 6 aa, Artificial Sequence
  Description of Artificial Sequence: Synthetic peptide
  MOD_RES (2)..(3): Any amino acid
PXXSGK

SEQ ID NO: 1935 - protein, 6 aa, Artificial Sequence
  Description of Artificial Sequence: Synthetic peptide
  MOD_RES (2)..(3): Any amino acid
KXXFTV

SEQ ID NO: 1936 - protein, 6 aa, Artificial Sequence
  Description of Artificial Sequence: Synthetic peptide
  MOD_RES (2)..(3): Any amino acid
RXXTFK

SEQ ID NO: 1937 - protein, 6 aa, Artificial Sequence
  Description of Artificial Sequence: Synthetic peptide
  MOD_RES (2)..(3): Any amino acid
GXXKTS

SEQ ID NO: 1938 - protein, 6 aa, Artificial Sequence
  Description of Artificial Sequence: Synthetic peptide
  MOD_RES (2)..(3): Any amino acid
QXXGKT

SEQ ID NO: 1939 - protein, 6 aa, Artificial Sequence
  Description of Artificial Sequence: Synthetic peptide
  MOD_RES (2)..(3): Any amino acid
DXXTGK

SEQ ID NO: 1940 - protein, 6 aa, Artificial Sequence
  Description of Artificial Sequence: Synthetic peptide
  MOD_RES (2)..(3): Any amino acid
LXXSGK

SEQ ID NO: 1941 - protein, 6 aa, Artificial Sequence
  Description of Artificial Sequence: Synthetic peptide
  MOD_RES (2)..(3): Any amino acid
QXXGYG

SEQ ID NO: 1942 - protein, 6 aa, Artificial Sequence
  Description of Artificial Sequence: Synthetic peptide
  MOD_RES (2)..(3): Any amino acid
MXXCTL

SEQ ID NO: 1943 - protein, 6 aa, Artificial Sequence
  Description of Artificial Sequence: Synthetic peptide
  MOD_RES (2)..(3): Any amino acid
QXXSCW

SEQ ID NO: 1944 - protein, 6 aa, Artificial Sequence
  Description of Artificial Sequence: Synthetic peptide
  MOD_RES (2)..(3): Any amino acid
MXXFKF

SEQ ID NO: 1945 - protein, 6 aa, Artificial Sequence
  Description of Artificial Sequence: Synthetic peptide
  MOD_RES (2)..(3): Any amino acid
GXXKSA

SEQ ID NO: 1946 - protein, 6 aa, Artificial Sequence
  Description of Artificial Sequence: Synthetic peptide
  MOD_RES (2)..(3): Any amino acid
LXXKDY

SEQ ID NO: 1947 - protein, 6 aa, Artificial Sequence
  Description of Artificial Sequence: Synthetic peptide
  MOD_RES (2)..(3): Any amino acid
RXXGIG

SEQ ID NO: 1948 - protein, 6 aa, Artificial Sequence
  Description of Artificial Sequence: Synthetic peptide
  MOD_RES (2)..(3): Any amino acid
SXXACW

SEQ ID NO: 1949 - protein, 6 aa, Artificial Sequence
  Description of Artificial Sequence: Synthetic peptide
  MOD_RES (2)..(3): Any amino acid
GXXIMS

SEQ ID NO: 1950 - protein, 6 aa, Artificial Sequence
  Description of Artificial Sequence: Synthetic peptide
  MOD_RES (2)..(3): Any amino acid
CXXGVG

SEQ ID NO: 1951 - protein, 6 aa, Artificial Sequence
  Description of Artificial Sequence: Synthetic peptide
  MOD_RES (2)..(3): Any amino acid
KXXACK

SEQ ID NO: 1952 - protein, 6 aa, Artificial Sequence
  Description of Artificial Sequence: Synthetic peptide
  MOD_RES (2)..(3): Any amino acid
GXXGKT

SEQ ID NO: 1953 - protein, 6 aa, Artificial Sequence
  Description of Artificial Sequence: Synthetic peptide
  MOD_RES (2)..(3): Any amino acid
NXXSGK

SEQ ID NO: 1954 - protein, 6 aa, Artificial Sequence
  Description of Artificial Sequence: Synthetic peptide
  MOD_RES (2)..(3): Any amino acid
QXXTGK

SEQ ID NO: 1955 - protein, 6 aa, Artificial Sequence
  Description of Artificial Sequence: Synthetic peptide
  MOD_RES (2)..(3): Any amino acid
IXXYTP

SEQ ID NO: 1956 - protein, 6 aa, Artificial Sequence
  Description of Artificial Sequence: Synthetic peptide
  MOD_RES (2)..(3): Any amino acid
NXXPNR

SEQ ID NO: 1957 - protein, 6 aa, Artificial Sequence
  Description of Artificial Sequence: Synthetic peptide
  MOD_RES (2)..(3): Any amino acid
MXXSRN

SEQ ID NO: 1958 - protein, 6 aa, Artificial Sequence
  Description of Artificial Sequence: Synthetic peptide
  MOD_RES (2)..(3): Any amino acid
NXXCKN

SEQ ID NO: 1959 - protein, 6 aa, Artificial Sequence
  Description of Artificial Sequence: Synthetic peptide
  MOD_RES (2)..(3): Any amino acid
SXXAGN

SEQ ID NO: 1960 - protein, 6 aa, Artificial Sequence
  Description of Artificial Sequence: Synthetic peptide
  MOD_RES (2)..(3): Any amino acid
AXXKTT

SEQ ID NO: 1961 - protein, 6 aa, Artificial Sequence
  Description of Artificial Sequence: Synthetic peptide
  MOD_RES (2)..(3): Any amino acid
EXXVGK

SEQ ID NO: 1962 - protein, 6 aa, Artificial Sequence
  Description of Artificial Sequence: Synthetic peptide
  MOD_RES (2)..(3): Any amino acid
VXXGCI

SEQ ID NO: 1963 - protein, 6 aa, Artificial Sequence
  Description of Artificial Sequence: Synthetic peptide
  MOD_RES (2)..(3): Any amino acid
CXXGIG

SEQ ID NO: 1964 - protein, 6 aa, Artificial Sequence
  Description of Artificial Sequence: Synthetic peptide
  MOD_RES (2)..(3): Any amino acid
RXXPFN

SEQ ID NO: 1965 - protein, 6 aa, Artificial Sequence
  Description of Artificial Sequence: Synthetic peptide
  MOD_RES (2)..(3): Any amino acid
SXXGKT

SEQ ID NO: 1966 - protein, 6 aa, Artificial Sequence
  Description of Artificial Sequence: Synthetic peptide
  MOD_RES (2)..(3): Any amino acid
KXXACH

SEQ ID NO: 1967 - protein, 6 aa, Artificial Sequence
  Description of Artificial Sequence: Synthetic peptide
  MOD_RES (2)..(3): Any amino acid
TXXGKS

SEQ ID NO: 1968 - protein, 6 aa, Artificial Sequence
  Description of Artificial Sequence: Synthetic peptide
  MOD_RES (2)..(3): Any amino acid
LXXICR

SEQ ID NO: 1969 - protein, 6 aa, Artificial Sequence
  Description of Artificial Sequence: Synthetic peptide
  MOD_RES (2)..(3): Any amino acid
SXXWPS

SEQ ID NO: 1970 - protein, 6 aa, Artificial Sequence
  Description of Artificial Sequence: Synthetic peptide
  MOD_RES (2)..(3): Any amino acid
RXXLPE

SEQ ID NO: 1971 - protein, 6 aa, Artificial Sequence
  Description of Artificial Sequence: Synthetic peptide
  MOD_RES (2)..(3): Any amino acid
RXXGLG

SEQ ID NO: 1972 - protein, 6 aa, Artificial Sequence
  Description of Artificial Sequence: Synthetic peptide
  MOD_RES (2)..(3): Any amino acid
KXXSPQ

SEQ ID NO: 1973 - protein, 6 aa, Artificial Sequence
  Description of Artificial Sequence: Synthetic peptide
  MOD_RES (2)..(3): Any amino acid
VXXGKT

SEQ ID NO: 1974 - protein, 6 aa, Artificial Sequence
  Description of Artificial Sequence: Synthetic peptide
  MOD_RES (2)..(3): Any amino acid
DXXGGG

SEQ ID NO: 1975 - protein, 6 aa, Artificial Sequence
  Description of Artificial Sequence: Synthetic peptide
  MOD_RES (2)..(3): Any amino acid
PXXGKG

SEQ ID NO: 1976 - protein, 6 aa, Artificial Sequence
  Description of Artificial Sequence: Synthetic peptide
  MOD_RES (2)..(3): Any amino acid
GXXLGR

SEQ ID NO: 1977 - protein, 6 aa, Artificial Sequence
  Description of Artificial Sequence: Synthetic peptide
  MOD_RES (2)..(3): Any amino acid
LXXGMV

SEQ ID NO: 1978 - protein, 6 aa, Artificial Sequence
  Description of Artificial Sequence: Synthetic peptide
  MOD_RES (2)..(3): Any amino acid
LXXAGK

SEQ ID NO: 1979 - protein, 6 aa, Artificial Sequence
  Description of Artificial Sequence: Synthetic peptide
  MOD_RES (2)..(3): Any amino acid
TXXGVH

SEQ ID NO: 1980 - protein, 6 aa, Artificial Sequence
  Description of Artificial Sequence: Synthetic peptide
  MOD_RES (2)..(3): Any amino acid
SXXSLS

SEQ ID NO: 1981 - protein, 6 aa, Artificial Sequence
  Description of Artificial Sequence: Synthetic peptide
  MOD_RES (2)..(3): Any amino acid
TXXIGE

SEQ ID NO: 1982 - protein, 6 aa, Artificial Sequence
  Description of Artificial Sequence: Synthetic peptide
  MOD_RES (2)..(3): Any amino acid
GXXGSC

SEQ ID NO: 1983 - protein, 6 aa, Artificial Sequence
  Description of Artificial Sequence: Synthetic peptide
  MOD_RES (2)..(3): Any amino acid
GXXKSS

SEQ ID NO: 1984 - protein, 6 aa, Artificial Sequence
  Description of Artificial Sequence: Synthetic peptide
  MOD_RES (2)..(3): Any amino acid
GXXKSC

SEQ ID NO: 1985 - protein, 6 aa, Artificial Sequence
  Description of Artificial Sequence: Synthetic peptide
  MOD_RES (2)..(3): Any amino acid
CXXGGW

SEQ ID NO: 1986 - protein, 6 aa, Artificial Sequence
  Description of Artificial Sequence: Synthetic peptide
  MOD_RES (2)..(3): Any amino acid
DXXDIG

SEQ ID NO: 1987 - protein, 6 aa, Artificial Sequence
  Description of Artificial Sequence: Synthetic peptide
  MOD_RES (2)..(3): Any amino acid
AXXGDS

SEQ ID NO: 1988 - protein, 6 aa, Artificial Sequence
  Description of Artificial Sequence: Synthetic peptide
  MOD_RES (2)..(3): Any amino acid
WXXGYA

SEQ ID NO: 1989 - protein, 6 aa, Artificial Sequence
  Description of Artificial Sequence: Synthetic peptide
  MOD_RES (2)..(3): Any amino acid
KXXRME

SEQ ID NO: 1990 - protein, 6 aa, Artificial Sequence
  Description of Artificial Sequence: Synthetic peptide
  MOD_RES (2)..(3): Any amino acid
QXXGIM

SEQ ID NO: 1991 - protein, 6 aa, Artificial Sequence
  Description of Artificial Sequence: Synthetic peptide
  MOD_RES (2)..(3): Any amino acid
KXXHPY

SEQ ID NO: 1992 - protein, 6 aa, Artificial Sequence
  Description of Artificial Sequence: Synthetic peptide
  MOD_RES (2)..(3): Any amino acid
NXXCGS

SEQ ID NO: 1993 - protein, 6 aa, Artificial Sequence
  Description of Artificial Sequence: Synthetic peptide
  MOD_RES (2)..(3): Any amino acid
GXXHDI

SEQ ID NO: 1994 - protein, 6 aa, Artificial Sequence
  Description of Artificial Sequence: Synthetic peptide
  MOD_RES (2)..(3): Any amino acid
GXXKTF

SEQ ID NO: 1995 - protein, 6 aa, Artificial Sequence
  Description of Artificial Sequence: Synthetic peptide
  MOD_RES (2)..(3): Any amino acid
VXXLMV

SEQ ID NO: 1996 - protein, 6 aa, Artificial Sequence
  Description of Artificial Sequence: Synthetic peptide
  MOD_RES (2)..(3): Any amino acid
LXXFMR

SEQ ID NO: 1997 - protein, 6 aa, Artificial Sequence
  Description of Artificial Sequence: Synthetic peptide
  MOD_RES (2)..(3): Any amino acid
KXXGLD

SEQ ID NO: 1998 - protein, 6 aa, Artificial Sequence
  Description of Artificial Sequence: Synthetic peptide
  MOD_RES (2)..(3): Any amino acid
GXXGFT

SEQ ID NO: 1999 - protein, 6 aa, Artificial Sequence
  Description of Artificial Sequence: Synthetic peptide
  MOD_RES (2)..(2): Any amino acid
  MOD_RES (4)..(5): Any amino acid
GXGXXT

SEQ ID NO: 2000 - protein, 6 aa, Artificial Sequence
  Description of Artificial Sequence: Synthetic peptide
  MOD_RES (2)..(2): Any amino acid
  MOD_RES (4)..(5): Any amino acid
VXCXXG

SEQ ID NO: 2001 - protein, 6 aa, Artificial Sequence
  Description of Artificial Sequence: Synthetic peptide
  MOD_RES (2)..(2): Any amino acid
  MOD_RES (4)..(5): Any amino acid
EXIXXW

SEQ ID NO: 2002 - protein, 6 aa, Artificial Sequence
  Description of Artificial Sequence: Synthetic peptide
  MOD_RES (2)..(2): Any amino acid
  MOD_RES (4)..(5): Any amino acid
SXKXXK

SEQ ID NO: 2003 - protein, 6 aa, Artificial Sequence
  Description of Artificial Sequence: Synthetic peptide
  MOD_RES (2)..(2): Any amino acid
  MOD_RES (4)..(5): Any amino acid
TXTXXT

SEQ ID NO: 2004 - protein, 6 aa, Artificial Sequence
  Description of Artificial Sequence: Synthetic peptide
  MOD_RES (2)..(2): Any amino acid
  MOD_RES (4)..(5): Any amino acid
GXSXXE

SEQ ID NO: 2005 - protein, 6 aa, Artificial Sequence
  Description of Artificial Sequence: Synthetic peptide
  MOD_RES (2)..(2): Any amino acid
  MOD_RES (4)..(5): Any amino acid
LXPXXR

SEQ ID NO: 2006 - protein, 6 aa, Artificial Sequence
  Description of Artificial Sequence: Synthetic peptide
  MOD_RES (2)..(2): Any amino acid
  MOD_RES (4)..(5): Any amino acid
GXPXXQ

SEQ ID NO: 2007 - protein, 6 aa, Artificial Sequence
  Description of Artificial Sequence: Synthetic peptide
  MOD_RES (2)..(2): Any amino acid
  MOD_RES (4)..(5): Any amino acid
NXTXXE

SEQ ID NO: 2008 - protein, 6 aa, Artificial Sequence
  Description of Artificial Sequence: Synthetic peptide
  MOD_RES (2)..(2): Any amino acid
  MOD_RES (4)..(5): Any amino acid
GXTXXQ

SEQ ID NO: 2009 - protein, 6 aa, Artificial Sequence
  Description of Artificial Sequence: Synthetic peptide
  MOD_RES (2)..(2): Any amino acid
  MOD_RES (4)..(5): Any amino acid
RXIXXF

SEQ ID NO: 2010 - protein, 6 aa, Artificial Sequence
  Description of Artificial Sequence: Synthetic peptide
  MOD_RES (2)..(2): Any amino acid
  MOD_RES (4)..(5): Any amino acid
GXGXXS

SEQ ID NO: 2011 - protein, 6 aa, Artificial Sequence
  Description of Artificial Sequence: Synthetic peptide
  MOD_RES (2)..(2): Any amino acid
  MOD_RES (4)..(5): Any amino acid
PXWXXG

SEQ ID NO: 2012 - protein, 6 aa, Artificial Sequence
  Description of Artificial Sequence: Synthetic peptide
  MOD_RES (2)..(2): Any amino acid
  MOD_RES (4)..(5): Any amino acid
SXAXXR

SEQ ID NO: 2013 - protein, 6 aa, Artificial Sequence
  Description of Artificial Sequence: Synthetic peptide
  MOD_RES (2)..(2): Any amino acid
  MOD_RES (4)..(5): Any amino acid
QXPXXL

SEQ ID NO: 2014 - protein, 6 aa, Artificial Sequence
  Description of Artificial Sequence: Synthetic peptide
  MOD_RES (2)..(2): Any amino acid
  MOD_RES (4)..(5): Any amino acid
DXAXXT

SEQ ID NO: 2015 - protein, 6 aa, Artificial Sequence
  Description of Artificial Sequence: Synthetic peptide
  MOD_RES (2)..(2): Any amino acid
  MOD_RES (4)..(5): Any amino acid
NXGXXT

SEQ ID NO: 2016 - protein, 6 aa, Artificial Sequence
  Description of Artificial Sequence: Synthetic peptide
  MOD_RES (2)..(2): Any amino acid
  MOD_RES (4)..(5): Any amino acid
LXEXXI

SEQ ID NO: 2017 - protein, 6 aa, Artificial Sequence
  Description of Artificial Sequence: Synthetic peptide
  MOD_RES (2)..(2): Any amino acid
  MOD_RES (4)..(5): Any amino acid
TXVXXK

SEQ ID NO: 2018 - protein, 6 aa, Artificial Sequence
  Description of Artificial Sequence: Synthetic peptide
  MOD_RES (2)..(2): Any amino acid
  MOD_RES (4)..(5): Any amino acid
LXEXXR

SEQ ID NO: 2019 - protein, 6 aa, Artificial Sequence
  Description of Artificial Sequence: Synthetic peptide
  MOD_RES (2)..(2): Any amino acid
  MOD_RES (4)..(5): Any amino acid
DXGXXK

SEQ ID NO: 2020 - protein, 6 aa, Artificial Sequence
  Description of Artificial Sequence: Synthetic peptide
  MOD_RES (2)..(2): Any amino acid
  MOD_RES (4)..(5): Any amino acid
LXPXXQ

SEQ ID NO: 2021 - protein, 6 aa, Artificial Sequence
  Description of Artificial Sequence: Synthetic peptide
  MOD_RES (2)..(2): Any amino acid
  MOD_RES (4)..(5): Any amino acid
EXSXXE

SEQ ID NO: 2022 - protein, 6 aa, Artificial Sequence
  Description of Artificial Sequence: Synthetic peptide
  MOD_RES (2)..(2): Any amino acid
  MOD_RES (4)..(5): Any amino acid
YXSXXT

SEQ ID NO: 2023 - protein, 6 aa, Artificial Sequence
  Description of Artificial Sequence: Synthetic peptide
  MOD_RES (2)..(2): Any amino acid
  MOD_RES (4)..(5): Any amino acid
GXSXXN

SEQ ID NO: 2024 - protein, 6 aa, Artificial Sequence
  Description of Artificial Sequence: Synthetic peptide
  MOD_RES (2)..(2): Any amino acid
  MOD_RES (4)..(5): Any amino acid
SXTXXD

SEQ ID NO: 2025 - protein, 6 aa, Artificial Sequence
  Description of Artificial Sequence: Synthetic peptide
  MOD_RES (2)..(2): Any amino acid
  MOD_RES (4)..(5): Any amino acid
RXDXXY

SEQ ID NO: 2026 - protein, 6 aa, Artificial Sequence
  Description of Artificial Sequence: Synthetic peptide
  MOD_RES (2)..(2): Any amino acid
  MOD_RES (4)..(5): Any amino acid
GXSXXT

SEQ ID NO: 2027 - protein, 6 aa, Artificial Sequence
  Description of Artificial Sequence: Synthetic peptide
  MOD_RES (2)..(2): Any amino acid
  MOD_RES (4)..(5): Any amino acid
PXHXXL

SEQ ID NO: 2028 - protein, 6 aa, Artificial Sequence
  Description of Artificial Sequence: Synthetic peptide
  MOD_RES (2)..(2): Any amino acid
  MOD_RES (4)..(5): Any amino acid
DXAXXQ

SEQ ID NO: 2029 - protein, 6 aa, Artificial Sequence
  Description of Artificial Sequence: Synthetic peptide
  MOD_RES (2)..(2): Any amino acid
  MOD_RES (4)..(5): Any amino acid
TXCXXC

SEQ ID NO: 2030 - protein, 6 aa, Artificial Sequence
  Description of Artificial Sequence: Synthetic peptide
  MOD_RES (2)..(2): Any amino acid
  MOD_RES (4)..(5): Any amino acid
GXSXXA

SEQ ID NO: 2031 - protein, 6 aa, Artificial Sequence
  Description of Artificial Sequence: Synthetic peptide
  MOD_RES (2)..(2): Any amino acid
  MOD_RES (4)..(5): Any amino acid
TXAXXE

SEQ ID NO: 2032 - protein, 6 aa, Artificial Sequence
  Description of Artificial Sequence: Synthetic peptide
  MOD_RES (2)..(2): Any amino acid
  MOD_RES (4)..(5): Any amino acid
CXAXXG

SEQ ID NO: 2033 - protein, 6 aa, Artificial Sequence
  Description of Artificial Sequence: Synthetic peptide
  MOD_RES (2)..(2): Any amino acid
  MOD_RES (4)..(5): Any amino acid
GXDXXQ

SEQ ID NO: 2034 - protein, 6 aa, Artificial Sequence
  Description of Artificial Sequence: Synthetic peptide
  MOD_RES (2)..(2): Any amino acid
  MOD_RES (4)..(5): Any amino acid
SXYXXE

SEQ ID NO: 2035 - protein, 6 aa, Artificial Sequence
  Description of Artificial Sequence: Synthetic peptide
  MOD_RES (2)..(2): Any amino acid
  MOD_RES (4)..(5): Any amino acid
CXNXXT

SEQ ID NO: 2036 - protein, 6 aa, Artificial Sequence
  Description of Artificial Sequence: Synthetic peptide
  MOD_RES (2)..(2): Any amino acid
  MOD_RES (4)..(5): Any amino acid
TXAXXK

SEQ ID NO: 2037 - protein, 6 aa, Artificial Sequence
  Description of Artificial Sequence: Synthetic peptide
  MOD_RES (2)..(2): Any amino acid
  MOD_RES (4)..(5): Any amino acid
SXSXXA

SEQ ID NO: 2038 - protein, 6 aa, Artificial Sequence
  Description of Artificial Sequence: Synthetic peptide
  MOD_RES (2)..(2): Any amino acid
  MOD_RES (4)..(5): Any amino acid
CXGXXY

SEQ ID NO: 2039 - protein, 6 aa, Artificial Sequence
  Description of Artificial Sequence: Synthetic peptide
  MOD_RES (2)..(2): Any amino acid
  MOD_RES (4)..(5): Any amino acid
LXDXXR

SEQ ID NO: 2040 - protein, 6 aa, Artificial Sequence
  Description of Artificial Sequence: Synthetic peptide
  MOD_RES (2)..(2): Any amino acid
  MOD_RES (4)..(5): Any amino acid
GXTXXD

SEQ ID NO: 2041 - protein, 6 aa, Artificial Sequence
  Description of Artificial Sequence: Synthetic peptide
  MOD_RES (2)..(2): Any amino acid
  MOD_RES (4)..(5): Any amino acid
LXSXXR

SEQ ID NO: 2042 - protein, 6 aa, Artificial Sequence
  Description of Artificial Sequence: Synthetic peptide
  MOD_RES (2)..(2): Any amino acid
  MOD_RES (4)..(5): Any amino acid
NXKXXK

SEQ ID NO: 2043 - protein, 6 aa, Artificial Sequence
  Description of Artificial Sequence: Synthetic peptide
  MOD_RES (2)..(2): Any amino acid
  MOD_RES (4)..(5): Any amino acid
GXGXXA

SEQ ID NO: 2044 - protein, 6 aa, Artificial Sequence
  Description of Artificial Sequence: Synthetic peptide
  MOD_RES (2)..(2): Any amino acid
  MOD_RES (4)..(5): Any amino acid
SXVXXS

SEQ ID NO: 2045 - protein, 6 aa, Artificial Sequence
  Description of Artificial Sequence: Synthetic peptide
  MOD_RES (2)..(2): Any amino acid
  MOD_RES (4)..(5): Any amino acid
LXEXXK

SEQ ID NO: 2046 - protein, 6 aa, Artificial Sequence
  Description of Artificial Sequence: Synthetic peptide
  MOD_RES (2)..(2): Any amino acid
  MOD_RES (4)..(5): Any amino acid
TXTXXE

SEQ ID NO: 2047 - protein, 6 aa, Artificial Sequence
  Description of Artificial Sequence: Synthetic peptide
  MOD_RES (2)..(2): Any amino acid
  MOD_RES (4)..(5): Any amino acid
SXGXXC

SEQ ID NO: 2048 - protein, 6 aa, Artificial Sequence
  Description of Artificial Sequence: Synthetic peptide
  MOD_RES (2)..(2): Any amino acid
  MOD_RES (4)..(5): Any amino acid
GXSXXD

SEQ ID NO: 2049 - protein, 6 aa, Artificial Sequence
  Description of Artificial Sequence: Synthetic peptide
  MOD_RES (2)..(2): Any amino acid
  MOD_RES (4)..(5): Any amino acid
GXSXXQ

SEQ ID NO: 2050 - protein, 6 aa, Artificial Sequence
  Description of Artificial Sequence: Synthetic peptide
  MOD_RES (2)..(2): Any amino acid
  MOD_RES (4)..(5): Any amino acid
FXVXXN

SEQ ID NO: 2051 - protein, 6 aa, Artificial Sequence
  Description of Artificial Sequence: Synthetic peptide
  MOD_RES (2)..(2): Any amino acid
  MOD_RES (4)..(5): Any amino acid
DXAXXE

SEQ ID NO: 2052 - protein, 6 aa, Artificial Sequence
  Description of Artificial Sequence: Synthetic peptide
  MOD_RES (2)..(2): Any amino acid
  MOD_RES (4)..(5): Any amino acid
FXTXXR

SEQ ID NO: 2053 - protein, 6 aa, Artificial Sequence
  Description of Artificial Sequence: Synthetic peptide
  MOD_RES (2)..(2): Any amino acid
  MOD_RES (4)..(5): Any amino acid
SXEXXR

SEQ ID NO: 2054 - protein, 6 aa, Artificial Sequence
  Description of Artificial Sequence: Synthetic peptide
  MOD_RES (2)..(2): Any amino acid
  MOD_RES (4)..(5): Any amino acid
SXAXXE

SEQ ID NO: 2055 - protein, 6 aa, Artificial Sequence
  Description of Artificial Sequence: Synthetic peptide
  MOD_RES (2)..(2): Any amino acid
  MOD_RES (4)..(5): Any amino acid
MXTXXF

SEQ ID NO: 2056 - protein, 6 aa, Artificial Sequence
  Description of Artificial Sequence: Synthetic peptide
  MOD_RES (2)..(2): Any amino acid
  MOD_RES (4)..(5): Any amino acid
RXSXXE

SEQ ID NO: 2057 - protein, 6 aa, Artificial Sequence
  Description of Artificial Sequence: Synthetic peptide
  MOD_RES (2)..(2): Any amino acid
  MOD_RES (4)..(5): Any amino acid
TXAXXQ

SEQ ID NO: 2058 - protein, 6 aa, Artificial Sequence
  Description of Artificial Sequence: Synthetic peptide
  MOD_RES (2)..(2): Any amino acid
  MOD_RES (4)..(5): Any amino acid
NXTXXR

SEQ ID NO: 2059 - protein, 6 aa, Artificial Sequence
  Description of Artificial Sequence: Synthetic peptide
  MOD_RES (2)..(2): Any amino acid
  MOD_RES (4)..(5): Any amino acid
NXSXXD

SEQ ID NO: 2060 - protein, 6 aa, Artificial Sequence
  Description of Artificial Sequence: Synthetic peptide
  MOD_RES (2)..(2): Any amino acid
  MOD_RES (4)..(5): Any amino acid
GXNXXE

SEQ ID NO: 2061 - protein, 6 aa, Artificial Sequence
  Description of Artificial Sequence: Synthetic peptide
  MOD_RES (2)..(2): Any amino acid
  MOD_RES (4)..(5): Any amino acid
LXAXXR

SEQ ID NO: 2062 - protein, 6 aa, Artificial Sequence
  Description of Artificial Sequence: Synthetic peptide
  MOD_RES (2)..(2): Any amino acid
  MOD_RES (4)..(5): Any amino acid
FXGXXA

SEQ ID NO: 2063 - protein, 6 aa, Artificial Sequence
  Description of Artificial Sequence: Synthetic peptide
  MOD_RES (2)..(2): Any amino acid
  MOD_RES (4)..(5): Any amino acid
QXRXXG

SEQ ID NO: 2064 - protein, 6 aa, Artificial Sequence
  Description of Artificial Sequence: Synthetic peptide
  MOD_RES (2)..(2): Any amino acid
  MOD_RES (4)..(5): Any amino acid
SXGXXR

SEQ ID NO: 2065 - protein, 6 aa, Artificial Sequence
  Description of Artificial Sequence: Synthetic peptide
  MOD_RES (2)..(2): Any amino acid
  MOD_RES (4)..(5): Any amino acid
EXDXXG

SEQ ID NO: 2066 - protein, 6 aa, Artificial Sequence
  Description of Artificial Sequence: Synthetic peptide
  MOD_RES (2)..(2): Any amino acid
  MOD_RES (4)..(5): Any amino acid
AXGXXT

SEQ ID NO: 2067 - protein, 6 aa, Artificial Sequence
  Description of Artificial Sequence: Synthetic peptide
  MOD_RES (2)..(2): Any amino acid
  MOD_RES (4)..(5): Any amino acid
DXAXXR

SEQ ID NO: 2068 - protein, 6 aa, Artificial Sequence
  Description of Artificial Sequence: Synthetic peptide
  MOD_RES (2)..(2): Any amino acid
  MOD_RES (4)..(5): Any amino acid
GXDXXA

SEQ ID NO: 2069 - protein, 6 aa, Artificial Sequence
  Description of Artificial Sequence: Synthetic peptide
  MOD_RES (2)..(2): Any amino acid
  MOD_RES (4)..(5): Any amino acid
GXTXXE

SEQ ID NO: 2070 - protein, 6 aa, Artificial Sequence
  Description of Artificial Sequence: Synthetic peptide
  MOD_RES (2)..(2): Any amino acid
  MOD_RES (4)..(5): Any amino acid
TXSXXE

SEQ ID NO: 2071 - protein, 6 aa, Artificial Sequence
  Description of Artificial Sequence: Synthetic peptide
  MOD_RES (2)..(2): Any amino acid
  MOD_RES (4)..(5): Any amino acid
PXTXXQ

SEQ ID NO: 2072 - protein, 6 aa, Artificial Sequence
  Description of Artificial Sequence: Synthetic peptide
  MOD_RES (2)..(2): Any amino acid
  MOD_RES (4)..(5): Any amino acid
TXDXXR

SEQ ID NO: 2073 - protein, 6 aa, Artificial Sequence
  Description of Artificial Sequence: Synthetic peptide
  MOD_RES (2)..(2): Any amino acid
  MOD_RES (4)..(5): Any amino acid
GXCXXC

SEQ ID NO: 2074 - protein, 6 aa, Artificial Sequence
  Description of Artificial Sequence: Synthetic peptide
  MOD_RES (2)..(2): Any amino acid
  MOD_RES (4)..(5): Any amino acid
SXAXXA

SEQ ID NO: 2075 - protein, 6 aa, Artificial Sequence
  Description of Artificial Sequence: Synthetic peptide
  MOD_RES (2)..(2): Any amino acid
  MOD_RES (4)..(5): Any amino acid
AXGXXK

SEQ ID NO: 2076 - protein, 6 aa, Artificial Sequence
  Description of Artificial Sequence: Synthetic peptide
  MOD_RES (2)..(2): Any amino acid
  MOD_RES (4)..(5): Any amino acid
QXRXXE

SEQ ID NO: 2077 - protein, 6 aa, Artificial Sequence
  Description of Artificial Sequence: Synthetic peptide
  MOD_RES (2)..(2): Any amino acid
  MOD_RES (4)..(5): Any amino acid
GXDXXE

SEQ ID NO: 2078 - protein, 6 aa, Artificial Sequence
  Description of Artificial Sequence: Synthetic peptide
  MOD_RES (2)..(2): Any amino acid
  MOD_RES (4)..(5): Any amino acid
NXAXXK

SEQ ID NO: 2079 - protein, 6 aa, Artificial Sequence
  Description of Artificial Sequence: Synthetic peptide
  MOD_RES (2)..(2): Any amino acid
  MOD_RES (4)..(5): Any amino acid
DXAXXD

SEQ ID NO: 2080 - protein, 6 aa, Artificial Sequence
  Description of Artificial Sequence: Synthetic peptide
  MOD_RES (2)..(2): Any amino acid
  MOD_RES (4)..(5): Any amino acid
TXAXXR

SEQ ID NO: 2081 - protein, 6 aa, Artificial Sequence
  Description of Artificial Sequence: Synthetic peptide
  MOD_RES (2)..(2): Any amino acid
  MOD_RES (4)..(5): Any amino acid
NXGXXK

SEQ ID NO: 2082 - protein, 6 aa, Artificial Sequence
  Description of Artificial Sequence: Synthetic peptide
  MOD_RES (2)..(2): Any amino acid
  MOD_RES (4)..(5): Any amino acid
DXAXXA

SEQ ID NO: 2083 - protein, 6 aa, Artificial Sequence
  Description of Artificial Sequence: Synthetic peptide
  MOD_RES (2)..(2): Any amino acid
  MOD_RES (4)..(5): Any amino acid
NXGXXS

SEQ ID NO: 2084 - protein, 6 aa, Artificial Sequence
  Description of Artificial Sequence: Synthetic peptide
  MOD_RES (2)..(2): Any amino acid
  MOD_RES (4)..(5): Any amino acid
GXGXXI

SEQ ID NO: 2085 - protein, 6 aa, Artificial Sequence
  Description of Artificial Sequence: Synthetic peptide
  MOD_RES (2)..(2): Any amino acid
  MOD_RES (4)..(5): Any amino acid
NXGXXV

SEQ ID NO: 2086 - protein, 6 aa, Artificial Sequence
  Description of Artificial Sequence: Synthetic peptide
  MOD_RES (2)..(2): Any amino acid
  MOD_RES (4)..(5): Any amino acid
KXSXXE

SEQ ID NO: 2087 - protein, 6 aa, Artificial Sequence
  Description of Artificial Sequence: Synthetic peptide
  MOD_RES (2)..(2): Any amino acid
  MOD_RES (4)..(5): Any amino acid
CXGXXC

SEQ ID NO: 2088 - protein, 6 aa, Artificial Sequence
  Description of Artificial Sequence: Synthetic peptide
  MOD_RES (2)..(2): Any amino acid
  MOD_RES (4)..(5): Any amino acid
SXTXXE

SEQ ID NO: 2089 - protein, 6 aa, Artificial Sequence
  Description of Artificial Sequence: Synthetic peptide
  MOD_RES (2)..(2): Any amino acid
  MOD_RES (4)..(5): Any amino acid
TXGXXT

SEQ ID NO: 2090 - protein, 6 aa, Artificial Sequence
  Description of Artificial Sequence: Synthetic peptide
  MOD_RES (2)..(2): Any amino acid
  MOD_RES (4)..(5): Any amino acid
SXAXXQ

SEQ ID NO: 2091 - protein, 6 aa, Artificial Sequence
  Description of Artificial Sequence: Synthetic peptide
  MOD_RES (2)..(2): Any amino acid
  MOD_RES (4)..(5): Any amino acid
NXAXXR

SEQ ID NO: 2092 - protein, 6 aa, Artificial Sequence
  Description of Artificial Sequence: Synthetic peptide
  MOD_RES (2)..(2): Any amino acid
  MOD_RES (4)..(5): Any amino acid
RXRXXN

SEQ ID NO: 2093 - protein, 6 aa, Artificial Sequence
  Description of Artificial Sequence: Synthetic peptide
  MOD_RES (2)..(2): Any amino acid
  MOD_RES (4)..(5): Any amino acid
LXDXXK

SEQ ID NO: 2094 - protein, 6 aa, Artificial Sequence
  Description of Artificial Sequence: Synthetic peptide
  MOD_RES (2)..(2): Any amino acid
  MOD_RES (4)..(5): Any amino acid
GXNXXQ

SEQ ID NO: 2095 - protein, 6 aa, Artificial Sequence
  Description of Artificial Sequence: Synthetic peptide
  MOD_RES (2)..(2): Any amino acid
  MOD_RES (4)..(5): Any amino acid
HXCXXH

SEQ ID NO: 2096 - protein, 6 aa, Artificial Sequence
  Description of Artificial Sequence: Synthetic peptide
  MOD_RES (2)..(2): Any amino acid
  MOD_RES (4)..(5): Any amino acid
FXHXXH

SEQ ID NO: 2097 - protein, 6 aa, Artificial Sequence
  Description of Artificial Sequence: Synthetic peptide
  MOD_RES (2)..(2): Any amino acid
  MOD_RES (4)..(5): Any amino acid
NXFXXA

SEQ ID NO: 2098 - protein, 6 aa, Artificial Sequence
  Description of Artificial Sequence: Synthetic peptide
  MOD_RES (2)..(2): Any amino acid
  MOD_RES (4)..(4): Any amino acid
SXKXDK

SEQ ID NO: 2099 - protein, 6 aa, Artificial Sequence
  Description of Artificial Sequence: Synthetic peptide
  MOD_RES (2)..(2): Any amino acid
  MOD_RES (4)..(4): Any amino acid
TXTXKT

SEQ ID NO: 2100 - protein, 6 aa, Artificial Sequence
  Description of Artificial Sequence: Synthetic peptide
  MOD_RES (2)..(2): Any amino acid
  MOD_RES (4)..(4): Any amino acid
TXVXKK

SEQ ID NO: 2101 - protein, 6 aa, Artificial Sequence
  Description of Artificial Sequence: Synthetic peptide
  MOD_RES (2)..(2): Any amino acid
  MOD_RES (4)..(4): Any amino acid
DXAXKT

SEQ ID NO: 2102 - protein, 6 aa, Artificial Sequence
  Description of Artificial Sequence: Synthetic peptide
  MOD_RES (2)..(2): Any amino acid
  MOD_RES (4)..(4): Any amino acid
VXCXNG

SEQ ID NO: 2103 - protein, 6 aa, Artificial Sequence
  Description of Artificial Sequence: Synthetic peptide
  MOD_RES (2)..(2): Any amino acid
  MOD_RES (4)..(4): Any amino acid
SXTXVD

SEQ ID NO: 2104 - protein, 6 aa, Artificial Sequence
  Description of Artificial Sequence: Synthetic peptide
  MOD_RES (2)..(2): Any amino acid
  MOD_RES (4)..(4): Any amino acid
DXGXGK

SEQ ID NO: 2105 - protein, 6 aa, Artificial Sequence
  Description of Artificial Sequence: Synthetic peptide
  MOD_RES (2)..(2): Any amino acid
  MOD_RES (4)..(4): Any amino acid
GXGXTT

SEQ ID NO: 2106 - protein, 6 aa, Artificial Sequence
  Description of Artificial Sequence: Synthetic peptide
  MOD_RES (2)..(2): Any amino acid
  MOD_RES (4)..(4): Any amino acid
GXGXST

SEQ ID NO: 2107 - protein, 6 aa, Artificial Sequence
  Description of Artificial Sequence: Synthetic peptide
  MOD_RES (2)..(2): Any amino acid
  MOD_RES (4)..(4): Any amino acid
SXGXGR

SEQ ID NO: 2108 - protein, 6 aa, Artificial Sequence
  Description of Artificial Sequence: Synthetic peptide
  MOD_RES (2)..(2): Any amino acid
  MOD_RES (4)..(4): Any amino acid
SXTXNT

SEQ ID NO: 2109 - protein, 6 aa, Artificial Sequence
  Description of Artificial Sequence: Synthetic peptide
  MOD_RES (2)..(2): Any amino acid
  MOD_RES (4)..(4): Any amino acid
NXKXDK

SEQ ID NO: 2110 - protein, 6 aa, Artificial Sequence
  Description of Artificial Sequence: Synthetic peptide
  MOD_RES (2)..(2): Any amino acid
  MOD_RES (4)..(4): Any amino acid
QXPXSL

SEQ ID NO: 2111 - protein, 6 aa, Artificial Sequence
  Description of Artificial Sequence: Synthetic peptide
  MOD_RES (2)..(2): Any amino acid
  MOD_RES (4)..(4): Any amino acid
YXSXRT

SEQ ID NO: 2112 - protein, 6 aa, Artificial Sequence
  Description of Artificial Sequence: Synthetic peptide
  MOD_RES (2)..(2): Any amino acid
  MOD_RES (4)..(4): Any amino acid
CXGXIC

SEQ ID NO: 2113 - protein, 6 aa, Artificial Sequence
  Description of Artificial Sequence: Synthetic peptide
  MOD_RES (2)..(2): Any amino acid
  MOD_RES (4)..(4): Any amino acid
SXVXKS

SEQ ID NO: 2114 - protein, 6 aa, Artificial Sequence
  Description of Artificial Sequence: Synthetic peptide
  MOD_RES (2)..(2): Any amino acid
  MOD_RES (4)..(4): Any amino acid
NXGXTT

SEQ ID NO: 2115 - protein, 6 aa, Artificial Sequence
  Description of Artificial Sequence: Synthetic peptide
  MOD_RES (2)..(2): Any amino acid
  MOD_RES (4)..(4): Any amino acid
PXWXIG

SEQ ID NO: 2116 - protein, 6 aa, Artificial Sequence
  Description of Artificial Sequence: Synthetic peptide
  MOD_RES (2)..(2): Any amino acid
  MOD_RES (4)..(4): Any amino acid
PXHXAL

SEQ ID NO: 2117 - protein, 6 aa, Artificial Sequence
  Description of Artificial Sequence: Synthetic peptide
  MOD_RES (2)..(2): Any amino acid
  MOD_RES (4)..(4): Any amino acid
HXAXVA

SEQ ID NO: 2118 - protein, 6 aa, Artificial Sequence
  Description of Artificial Sequence: Synthetic peptide
  MOD_RES (2)..(2): Any amino acid
  MOD_RES (4)..(4): Any amino acid
RXTXDD

SEQ ID NO: 2119 - protein, 6 aa, Artificial Sequence
  Description of Artificial Sequence: Synthetic peptide
  MOD_RES (2)..(2): Any amino acid
  MOD_RES (4)..(4): Any amino acid
DXSXNT

SEQ ID NO: 2120 - protein, 6 aa, Artificial Sequence
  Description of Artificial Sequence: Synthetic peptide
  MOD_RES (2)..(2): Any amino acid
  MOD_RES (4)..(4): Any amino acid
LXAXVK

SEQ ID NO: 2121 - protein, 6 aa, Artificial Sequence
  Description of Artificial Sequence: Synthetic peptide
  MOD_RES (2)..(2): Any amino acid
  MOD_RES (4)..(4): Any amino acid
NXFXDS

SEQ ID NO: 2122 - protein, 6 aa, Artificial Sequence
  Description of Artificial Sequence: Synthetic peptide
  MOD_RES (2)..(2): Any amino acid
  MOD_RES (4)..(4): Any amino acid
YXIXTG

SEQ ID NO: 2123 - protein, 6 aa, Artificial Sequence
  Description of Artificial Sequence: Synthetic peptide
  MOD_RES (2)..(2): Any amino acid
  MOD_RES (4)..(4): Any amino acid
MXYXKI

SEQ ID NO: 2124 - protein, 6 aa, Artificial Sequence
  Description of Artificial Sequence: Synthetic peptide
  MOD_RES (2)..(2): Any amino acid
  MOD_RES (4)..(4): Any amino acid
GXGXTS

SEQ ID NO: 2125 - protein, 6 aa, Artificial Sequence
  Description of Artificial Sequence: Synthetic peptide
  MOD_RES (2)..(2): Any amino acid
  MOD_RES (4)..(4): Any amino acid
PXGXGK

SEQ ID NO: 2126 - protein, 6 aa, Artificial Sequence
  Description of Artificial Sequence: Synthetic peptide
  MOD_RES (2)..(2): Any amino acid
  MOD_RES (4)..(4): Any amino acid
KXVXCK

SEQ ID NO: 2127 - protein, 6 aa, Artificial Sequence
  Description of Artificial Sequence: Synthetic peptide
  MOD_RES (2)..(2): Any amino acid
  MOD_RES (4)..(4): Any amino acid
AXGXGK

SEQ ID NO: 2128 - protein, 6 aa, Artificial Sequence
  Description of Artificial Sequence: Synthetic peptide
  MOD_RES (2)..(2): Any amino acid
  MOD_RES (4)..(4): Any amino acid
CXAXIG

SEQ ID NO: 2129 - protein, 6 aa, Artificial Sequence
  Description of Artificial Sequence: Synthetic peptide
  MOD_RES (2)..(2): Any amino acid
  MOD_RES (4)..(4): Any amino acid
LXNXGK

SEQ ID NO: 2130 - protein, 6 aa, Artificial Sequence
  Description of Artificial Sequence: Synthetic peptide
  MOD_RES (2)..(2): Any amino acid
  MOD_RES (4)..(4): Any amino acid
SXGXGC

SEQ ID NO: 2131 - protein, 6 aa, Artificial Sequence
  Description of Artificial Sequence: Synthetic peptide
  MOD_RES (2)..(2): Any amino acid
  MOD_RES (4)..(4): Any amino acid
NXGXGK

SEQ ID NO: 2132 - protein, 6 aa, Artificial Sequence
  Description of Artificial Sequence: Synthetic peptide
  MOD_RES (2)..(2): Any amino acid
  MOD_RES (4)..(4): Any amino acid
SXGXGR

SEQ ID NO: 2133 - protein, 6 aa, Artificial Sequence
  Description of Artificial Sequence: Synthetic peptide
  MOD_RES (2)..(2): Any amino acid
  MOD_RES (4)..(4): Any amino acid
LXNXCR

SEQ ID NO: 2134 - protein, 6 aa, Artificial Sequence
  Description of Artificial Sequence: Synthetic peptide
  MOD_RES (2)..(2): Any amino acid
  MOD_RES (4)..(4): Any amino acid
QXGXCW

SEQ ID NO: 2135 - protein, 6 aa, Artificial Sequence
  Description of Artificial Sequence: Synthetic peptide
  MOD_RES (2)..(2): Any amino acid
  MOD_RES (4)..(4): Any amino acid
CXAXVG

SEQ ID NO: 2136 - protein, 6 aa, Artificial Sequence
  Description of Artificial Sequence: Synthetic peptide
  MOD_RES (2)..(2): Any amino acid
  MOD_RES (4)..(4): Any amino acid
LXGXGK

SEQ ID NO: 2137 - protein, 6 aa, Artificial Sequence
  Description of Artificial Sequence: Synthetic peptide
  MOD_RES (2)..(2): Any amino acid
  MOD_RES (4)..(4): Any amino acid
NXTXNR

SEQ ID NO: 2138 - protein, 6 aa, Artificial Sequence
  Description of Artificial Sequence: Synthetic peptide
  MOD_RES (2)..(2): Any amino acid
  MOD_RES (4)..(4): Any amino acid
MXTXKF

SEQ ID NO: 2139 - protein, 6 aa, Artificial Sequence
  Description of Artificial Sequence: Synthetic peptide
  MOD_RES (2)..(2): Any amino acid
  MOD_RES (4)..(4): Any amino acid
QXSXKT

SEQ ID NO: 2140 - protein, 6 aa, Artificial Sequence
  Description of Artificial Sequence: Synthetic peptide
  MOD_RES (2)..(2): Any amino acid
  MOD_RES (4)..(4): Any amino acid
AXRXNF

SEQ ID NO: 2141 - protein, 6 aa, Artificial Sequence
  Description of Artificial Sequence: Synthetic peptide
  MOD_RES (2)..(2): Any amino acid
  MOD_RES (4)..(4): Any amino acid
QXGXGK

SEQ ID NO: 2142 - protein, 6 aa, Artificial Sequence
  Description of Artificial Sequence: Synthetic peptide
  MOD_RES (2)..(2): Any amino acid
  MOD_RES (4)..(4): Any amino acid
TXNXGE

SEQ ID NO: 2143 - protein, 6 aa, Artificial Sequence
  Description of Artificial Sequence: Synthetic peptide
  MOD_RES (2)..(2): Any amino acid
  MOD_RES (4)..(4): Any amino acid
IXNXTP

SEQ ID NO: 2144 - protein, 6 aa, Artificial Sequence
  Description of Artificial Sequence: Synthetic peptide
  MOD_RES (2)..(2): Any amino acid
  MOD_RES (4)..(4): Any amino acid
CXAXIG

SEQ ID NO: 2145 - protein, 6 aa, Artificial Sequence
  Description of Artificial Sequence: Synthetic peptide
  MOD_RES (2)..(2): Any amino acid
  MOD_RES (4)..(4): Any amino acid
TXCXVH

SEQ ID NO: 2146 - protein, 6 aa, Artificial Sequence
  Description of Artificial Sequence: Synthetic peptide
  MOD_RES (2)..(2): Any amino acid
  MOD_RES (4)..(4): Any amino acid
YXDXFQ

SEQ ID NO: 2147 - protein, 6 aa, Artificial Sequence
  Description of Artificial Sequence: Synthetic peptide
  MOD_RES (2)..(2): Any amino acid
  MOD_RES (4)..(4): Any amino acid
AXNXRV

SEQ ID NO: 2148 - protein, 6 aa, Artificial Sequence
  Description of Artificial Sequence: Synthetic peptide
  MOD_RES (2)..(2): Any amino acid
  MOD_RES (4)..(4): Any amino acid
GXGXSA

SEQ ID NO: 2149 - protein, 6 aa, Artificial Sequence
  Description of Artificial Sequence: Synthetic peptide
  MOD_RES (2)..(2): Any amino acid
  MOD_RES (4)..(4): Any amino acid
AXGXTT

SEQ ID NO: 2150 - protein, 6 aa, Artificial Sequence
  Description of Artificial Sequence: Synthetic peptide
  MOD_RES (2)..(2): Any amino acid
  MOD_RES (4)..(4): Any amino acid
SXGXCW

SEQ ID NO: 2151 - protein, 6 aa, Artificial Sequence
  Description of Artificial Sequence: Synthetic peptide
  MOD_RES (2)..(2): Any amino acid
  MOD_RES (4)..(4): Any amino acid
RXRXFN

SEQ ID NO: 2152 - protein, 6 aa, Artificial Sequence
  Description of Artificial Sequence: Synthetic peptide
  MOD_RES (2)..(2): Any amino acid
  MOD_RES (4)..(4): Any amino acid
QXSXGA

SEQ ID NO: 2153 - protein, 6 aa, Artificial Sequence
  Description of Artificial Sequence: Synthetic peptide
  MOD_RES (2)..(2): Any amino acid
  MOD_RES (4)..(4): Any amino acid
MXLXTL

SEQ ID NO: 2154 - protein, 6 aa, Artificial Sequence
  Description of Artificial Sequence: Synthetic peptide
  MOD_RES (2)..(2): Any amino acid
  MOD_RES (4)..(4): Any amino acid
TXSXKT

SEQ ID NO: 2155 - protein, 6 aa, Artificial Sequence
  Description of Artificial Sequence: Synthetic peptide
  MOD_RES (2)..(2): Any amino acid
  MOD_RES (4)..(4): Any amino acid
DXHXIG

SEQ ID NO: 2156 - protein, 6 aa, Artificial Sequence
  Description of Artificial Sequence: Synthetic peptide
  MOD_RES (2)..(2): Any amino acid
  MOD_RES (4)..(4): Any amino acid
NXQXQF

SEQ ID NO: 2157 - protein, 6 aa, Artificial Sequence
  Description of Artificial Sequence: Synthetic peptide
  MOD_RES (2)..(2): Any amino acid
  MOD_RES (4)..(4): Any amino acid
LXVXMV

SEQ ID NO: 2158 - protein, 6 aa, Artificial Sequence
  Description of Artificial Sequence: Synthetic peptide
  MOD_RES (2)..(2): Any amino acid
  MOD_RES (4)..(4): Any amino acid
QXQXIM

SEQ ID NO: 2159 - protein, 6 aa, Artificial Sequence
  Description of Artificial Sequence: Synthetic peptide
  MOD_RES (2)..(2): Any amino acid
  MOD_RES (4)..(4): Any amino acid
RXVXYT

SEQ ID NO: 2160 - protein, 6 aa, Artificial Sequence
  Description of Artificial Sequence: Synthetic peptide
  MOD_RES (2)..(2): Any amino acid
  MOD_RES (4)..(4): Any amino acid
HXDXGK

SEQ ID NO: 2161 - protein, 6 aa, Artificial Sequence
  Description of Artificial Sequence: Synthetic peptide
  MOD_RES (2)..(2): Any amino acid
  MOD_RES (4)..(4): Any amino acid
GXGXGR

SEQ ID NO: 2162 - protein, 6 aa, Artificial Sequence
  Description of Artificial Sequence: Synthetic peptide
  MOD_RES (2)..(2): Any amino acid
  MOD_RES (4)..(4): Any amino acid
WXHXYA

SEQ ID NO: 2163 - protein, 6 aa, Artificial Sequence
  Description of Artificial Sequence: Synthetic peptide
  MOD_RES (2)..(2): Any amino acid
  MOD_RES (4)..(4): Any amino acid
WXNXFT

SEQ ID NO: 2164 - protein, 6 aa, Artificial Sequence
  Description of Artificial Sequence: Synthetic peptide
  MOD_RES (2)..(2): Any amino acid
  MOD_RES (4)..(4): Any amino acid
FXEXLT

SEQ ID NO: 2165 - protein, 6 aa, Artificial Sequence
  Description of Artificial Sequence: Synthetic peptide
  MOD_RES (2)..(2): Any amino acid
  MOD_RES (4)..(4): Any amino acid
NXFXVA

SEQ ID NO: 2166 - protein, 6 aa, Artificial Sequence
  Description of Artificial Sequence: Synthetic peptide
  MOD_RES (2)..(2): Any amino acid
  MOD_RES (4)..(4): Any amino acid
GXTXKT

SEQ ID NO: 2167 - protein, 6 aa, Artificial Sequence
  Description of Artificial Sequence: Synthetic peptide
  MOD_RES (2)..(2): Any amino acid
  MOD_RES (4)..(4): Any amino acid
GXGXSS

SEQ ID NO: 2168 - protein, 6 aa, Artificial Sequence
  Description of Artificial Sequence: Synthetic peptide
  MOD_RES (2)..(2): Any amino acid
  MOD_RES (4)..(4): Any amino acid
VXWXRG

SEQ ID NO: 2169 - protein, 6 aa, Artificial Sequence
  Description of Artificial Sequence: Synthetic peptide
  MOD_RES (2)..(2): Any amino acid
  MOD_RES (4)..(4): Any amino acid
EXGXSK

SEQ ID NO: 2170 - protein, 6 aa, Artificial Sequence
  Description of Artificial Sequence: Synthetic peptide
  MOD_RES (2)..(2): Any amino acid
  MOD_RES (4)..(4): Any amino acid
SXGXGK

SEQ ID NO: 2171 - protein, 6 aa, Artificial Sequence
  Description of Artificial Sequence: Synthetic peptide
  MOD_RES (2)..(2): Any amino acid
  MOD_RES (4)..(4): Any amino acid
QXRXYG

SEQ ID NO: 2172 - protein, 6 aa, Artificial Sequence
  Description of Artificial Sequence: Synthetic peptide
  MOD_RES (2)..(2): Any amino acid
  MOD_RES (4)..(4): Any amino acid
TXPXVY

SEQ ID NO: 2173 - protein, 6 aa, Artificial Sequence
  Description of Artificial Sequence: Synthetic peptide
  MOD_RES (2)..(2): Any amino acid
  MOD_RES (4)..(4): Any amino acid
VXHXKT

SEQ ID NO: 2174 - protein, 6 aa, Artificial Sequence
  Description of Artificial Sequence: Synthetic peptide
  MOD_RES (2)..(2): Any amino acid
  MOD_RES (4)..(4): Any amino acid
YXFXLH

SEQ ID NO: 2175 - protein, 6 aa, Artificial Sequence
  Description of Artificial Sequence: Synthetic peptide
  MOD_RES (2)..(2): Any amino acid
  MOD_RES (4)..(4): Any amino acid
DXRXTG

SEQ ID NO: 2176 - protein, 6 aa, Artificial Sequence
  Description of Artificial Sequence: Synthetic peptide
  MOD_RES (2)..(2): Any amino acid
  MOD_RES (4)..(4): Any amino acid
GXVXKS

SEQ ID NO: 2177 - protein, 6 aa, Artificial Sequence
  Description of Artificial Sequence: Synthetic peptide
  MOD_RES (2)..(2): Any amino acid
  MOD_RES (4)..(4): Any amino acid
AXTXKS

SEQ ID NO: 2178 - protein, 6 aa, Artificial Sequence
  Description of Artificial Sequence: Synthetic peptide
  MOD_RES (2)..(2): Any amino acid
  MOD_RES (4)..(4): Any amino acid
GXCXSC

SEQ ID NO: 2179 - protein, 6 aa, Artificial Sequence
  Description of Artificial Sequence: Synthetic peptide
  MOD_RES (2)..(2): Any amino acid
  MOD_RES (4)..(4): Any amino acid
GXGXSI

SEQ ID NO: 2180 - protein, 6 aa, Artificial Sequence
  Description of Artificial Sequence: Synthetic peptide
  MOD_RES (2)..(2): Any amino acid
  MOD_RES (4)..(4): Any amino acid
KXYXME

SEQ ID NO: 2181 - protein, 6 aa, Artificial Sequence
  Description of Artificial Sequence: Synthetic peptide
  MOD_RES (2)..(2): Any amino acid
  MOD_RES (4)..(4): Any amino acid
EXCXLG

SEQ ID NO: 2182 - protein, 6 aa, Artificial Sequence
  Description of Artificial Sequence: Synthetic peptide
  MOD_RES (2)..(2): Any amino acid
  MOD_RES (4)..(4): Any amino acid
DXGXTT

SEQ ID NO: 2183 - protein, 6 aa, Artificial Sequence
  Description of Artificial Sequence: Synthetic peptide
  MOD_RES (2)..(2): Any amino acid
  MOD_RES (4)..(4): Any amino acid
NXAXKN

SEQ ID NO: 2184 - protein, 6 aa, Artificial Sequence
  Description of Artificial Sequence: Synthetic peptide
  MOD_RES (2)..(2): Any amino acid
  MOD_RES (4)..(4): Any amino acid
SXVXKT

SEQ ID NO: 2185 - protein, 6 aa, Artificial Sequence
  Description of Artificial Sequence: Synthetic peptide
  MOD_RES (2)..(2): Any amino acid
  MOD_RES (4)..(4): Any amino acid
GXGXSC

SEQ ID NO: 2186 - protein, 6 aa, Artificial Sequence
  Description of Artificial Sequence: Synthetic peptide
  MOD_RES (2)..(2): Any amino acid
  MOD_RES (4)..(4): Any amino acid
RXGXGR

SEQ ID NO: 2187 - protein, 6 aa, Artificial Sequence
  Description of Artificial Sequence: Synthetic peptide
  MOD_RES (2)..(2): Any amino acid
  MOD_RES (4)..(4): Any amino acid
GXTXEK

SEQ ID NO: 2188 - protein, 6 aa, Artificial Sequence
  Description of Artificial Sequence: Synthetic peptide
  MOD_RES (2)..(2): Any amino acid
  MOD_RES (4)..(4): Any amino acid
GXSXET

SEQ ID NO: 2189 - protein, 6 aa, Artificial Sequence
  Description of Artificial Sequence: Synthetic peptide
  MOD_RES (2)..(2): Any amino acid
  MOD_RES (4)..(4): Any amino acid
GXGXSN

SEQ ID NO: 2190 - protein, 6 aa, Artificial Sequence
  Description of Artificial Sequence: Synthetic peptide
  MOD_RES (2)..(2): Any amino acid
  MOD_RES (4)..(4): Any amino acid
SXSXKS

SEQ ID NO: 2191 - protein, 6 aa, Artificial Sequence
  Description of Artificial Sequence: Synthetic peptide
  MOD_RES (2)..(2): Any amino acid
  MOD_RES (4)..(4): Any amino acid
LXPXEF

SEQ ID NO: 2192 - protein, 6 aa, Artificial Sequence
  Description of Artificial Sequence: Synthetic peptide
  MOD_RES (2)..(2): Any amino acid
  MOD_RES (4)..(4): Any amino acid
IXGXSA

SEQ ID NO: 2193 - protein, 6 aa, Artificial Sequence
  Description of Artificial Sequence: Synthetic peptide
  MOD_RES (2)..(2): Any amino acid
  MOD_RES (4)..(4): Any amino acid
GXDXYR

SEQ ID NO: 2194 - protein, 6 aa, Artificial Sequence
  Description of Artificial Sequence: Synthetic peptide
  MOD_RES (2)..(2): Any amino acid
  MOD_RES (4)..(4): Any amino acid
QXRXLG

SEQ ID NO: 2195 - protein, 6 aa, Artificial Sequence
  Description of Artificial Sequence: Synthetic peptide
  MOD_RES (2)..(2): Any amino acid
  MOD_RES (4)..(4): Any amino acid
VXFXFP

SEQ ID NO: 2196 - protein, 6 aa, Artificial Sequence
  Description of Artificial Sequence: Synthetic peptide
  MOD_RES (2)..(2): Any amino acid
  MOD_RES (4)..(4): Any amino acid
NXFXGS

SEQ ID NO: 2197 - protein, 6 aa, Artificial Sequence
  Description of Artificial Sequence: Synthetic peptide
  MOD_RES (2)..(2): Any amino acid
  MOD_RES (5)..(5): Any amino acid
GXGKXT

SEQ ID NO: 2198 - protein, 6 aa, Artificial Sequence
  Description of Artificial Sequence: Synthetic peptide
  MOD_RES (2)..(2): Any amino acid
  MOD_RES (5)..(5): Any amino acid
SXKVXK

SEQ ID NO: 2199 - protein, 6 aa, Artificial Sequence
  Description of Artificial Sequence: Synthetic peptide
  MOD_RES (2)..(2): Any amino acid
  MOD_RES (5)..(5): Any amino acid
TXTGXT

SEQ ID NO: 2200 - protein, 6 aa, Artificial Sequence
  Description of Artificial Sequence: Synthetic peptide
  MOD_RES (2)..(2): Any amino acid
  MOD_RES (5)..(5): Any amino acid
VXCKXG

SEQ ID NO: 2201 - protein, 6 aa, Artificial Sequence
  Description of Artificial Sequence: Synthetic peptide
  MOD_RES (2)..(2): Any amino acid
  MOD_RES (5)..(5): Any amino acid
DXAGXT

SEQ ID NO: 2202 - protein, 6 aa, Artificial Sequence
  Description of Artificial Sequence: Synthetic peptide
  MOD_RES (2)..(2): Any amino acid
  MOD_RES (5)..(5): Any amino acid
TXVDXK

SEQ ID NO: 2203 - protein, 6 aa, Artificial Sequence
  Description of Artificial Sequence: Synthetic peptide
  MOD_RES (2)..(2): Any amino acid
  MOD_RES (5)..(5): Any amino acid
NXGKXT

SEQ ID NO: 2204 - protein, 6 aa, Artificial Sequence
  Description of Artificial Sequence: Synthetic peptide
  MOD_RES (2)..(2): Any amino acid
  MOD_RES (5)..(5): Any amino acid
GXGKXS

SEQ ID NO: 2205 - protein, 6 aa, Artificial Sequence
  Description of Artificial Sequence: Synthetic peptide
  MOD_RES (2)..(2): Any amino acid
  MOD_RES (5)..(5): Any amino acid
SXTKXD

SEQ ID NO: 2206 - protein, 6 aa, Artificial Sequence
  Description of Artificial Sequence: Synthetic peptide
  MOD_RES (2)..(2): Any amino acid
  MOD_RES (5)..(5): Any amino acid
FXGHXA

SEQ ID NO: 2207 - protein, 6 aa, Artificial Sequence
  Description of Artificial Sequence: Synthetic peptide
  MOD_RES (2)..(2): Any amino acid
  MOD_RES (5)..(5): Any amino acid
CXAGXG

SEQ ID NO: 2208 - protein, 6 aa, Artificial Sequence
  Description of Artificial Sequence: Synthetic peptide
  MOD_RES (2)..(2): Any amino acid
  MOD_RES (5)..(5): Any amino acid
AXGKXT

SEQ ID NO: 2209 - protein, 6 aa, Artificial Sequence
  Description of Artificial Sequence: Synthetic peptide
  MOD_RES (2)..(2): Any amino acid
  MOD_RES (5)..(5): Any amino acid
DXGVXK

SEQ ID NO: 2210 - protein, 6 aa, Artificial Sequence
  Description of Artificial Sequence: Synthetic peptide
  MOD_RES (2)..(2): Any amino acid
  MOD_RES (5)..(5): Any amino acid
NXKVXK

SEQ ID NO: 2211 - protein, 6 aa, Artificial Sequence
  Description of Artificial Sequence: Synthetic peptide
  MOD_RES (2)..(2): Any amino acid
  MOD_RES (5)..(5): Any amino acid
PXWNXG

SEQ ID NO: 2212 - protein, 6 aa, Artificial Sequence
  Description of Artificial Sequence: Synthetic peptide
  MOD_RES (2)..(2): Any amino acid
  MOD_RES (5)..(5): Any amino acid
YXSGXT

SEQ ID NO: 2213 - protein, 6 aa, Artificial Sequence
  Description of Artificial Sequence: Synthetic peptide
  MOD_RES (2)..(2): Any amino acid
  MOD_RES (5)..(5): Any amino acid
CXNGXT

SEQ ID NO: 2214 - protein, 6 aa, Artificial Sequence
  Description of Artificial Sequence: Synthetic peptide
  MOD_RES (2)..(2): Any amino acid
  MOD_RES (5)..(5): Any amino acid
SXVGXS

SEQ ID NO: 2215 - protein, 6 aa, Artificial Sequence
  Description of Artificial Sequence: Synthetic peptide
  MOD_RES (2)..(2): Any amino acid
  MOD_RES (5)..(5): Any amino acid
TXDDXQ

SEQ ID NO: 2216 - protein, 6 aa, Artificial Sequence
  Description of Artificial Sequence: Synthetic peptide
  MOD_RES (2)..(2): Any amino acid
  MOD_RES (5)..(5): Any amino acid
CXGNXC

SEQ ID NO: 2217 - protein, 6 aa, Artificial Sequence
  Description of Artificial Sequence: Synthetic peptide
  MOD_RES (2)..(2): Any amino acid
  MOD_RES (5)..(5): Any amino acid
AXKLXP

SEQ ID NO: 2218 - protein, 6 aa, Artificial Sequence
  Description of Artificial Sequence: Synthetic peptide
  MOD_RES (2)..(2): Any amino acid
  MOD_RES (5)..(5): Any amino acid
FXISXI

SEQ ID NO: 2219 - protein, 6 aa, Artificial Sequence
  Description of Artificial Sequence: Synthetic peptide
  MOD_RES (2)..(2): Any amino acid
  MOD_RES (5)..(5): Any amino acid
MXYIXI

SEQ ID NO: 2220 - protein, 6 aa, Artificial Sequence
  Description of Artificial Sequence: Synthetic peptide
  MOD_RES (2)..(2): Any amino acid
  MOD_RES (5)..(5): Any amino acid
YXKIXA

SEQ ID NO: 2221 - protein, 6 aa, Artificial Sequence
  Description of Artificial Sequence: Synthetic peptide
  MOD_RES (2)..(2): Any amino acid
  MOD_RES (5)..(5): Any amino acid
SXTGXT

SEQ ID NO: 2222 - protein, 6 aa, Artificial Sequence
  Description of Artificial Sequence: Synthetic peptide
  MOD_RES (2)..(2): Any amino acid
  MOD_RES (5)..(5): Any amino acid
SXGVXR

SEQ ID NO: 2223 - protein, 6 aa, Artificial Sequence
  Description of Artificial Sequence: Synthetic peptide
  MOD_RES (2)..(2): Any amino acid
  MOD_RES (5)..(5): Any amino acid
GXGKXA

SEQ ID NO: 2224 - protein, 6 aa, Artificial Sequence
  Description of Artificial Sequence: Synthetic peptide
  MOD_RES (2)..(2): Any amino acid
  MOD_RES (5)..(5): Any amino acid
MXLCXL

SEQ ID NO: 2225 - protein, 6 aa, Artificial Sequence
  Description of Artificial Sequence: Synthetic peptide
  MOD_RES (2)..(2): Any amino acid
  MOD_RES (5)..(5): Any amino acid
GXGFXI

SEQ ID NO: 2226 - protein, 6 aa, Artificial Sequence
  Description of Artificial Sequence: Synthetic peptide
  MOD_RES (2)..(2): Any amino acid
  MOD_RES (5)..(5): Any amino acid
PXGSXK

SEQ ID NO: 2227 - protein, 6 aa, Artificial Sequence
  Description of Artificial Sequence: Synthetic peptide
  MOD_RES (2)..(2): Any amino acid
  MOD_RES (5)..(5): Any amino acid
VXWGXG

SEQ ID NO: 2228 - protein, 6 aa, Artificial Sequence
  Description of Artificial Sequence: Synthetic peptide
  MOD_RES (2)..(2): Any amino acid
  MOD_RES (5)..(5): Any amino acid
SXGIXR

SEQ ID NO: 2229 - protein, 6 aa, Artificial Sequence
  Description of Artificial Sequence: Synthetic peptide
  MOD_RES (2)..(2): Any amino acid
  MOD_RES (5)..(5): Any amino acid
MXTFXF

SEQ ID NO: 2230 - protein, 6 aa, Artificial Sequence
  Description of Artificial Sequence: Synthetic peptide
  MOD_RES (2)..(2): Any amino acid
  MOD_RES (5)..(5): Any amino acid
LXNAXK

SEQ ID NO: 2231 - protein, 6 aa, Artificial Sequence
  Description of Artificial Sequence: Synthetic peptide
  MOD_RES (2)..(2): Any amino acid
  MOD_RES (5)..(5): Any amino acid
QXRGXG

SEQ ID NO: 2232 - protein, 6 aa, Artificial Sequence
  Description of Artificial Sequence: Synthetic peptide
  MOD_RES (2)..(2): Any amino acid
  MOD_RES (5)..(5): Any amino acid
SXGIXR

SEQ ID NO: 2233 - protein, 6 aa, Artificial Sequence
  Description of Artificial Sequence: Synthetic peptide
  MOD_RES (2)..(2): Any amino acid
  MOD_RES (5)..(5): Any amino acid
NXACXN

SEQ ID NO: 2234 - protein, 6 aa, Artificial Sequence
  Description of Artificial Sequence: Synthetic peptide
  MOD_RES (2)..(2): Any amino acid
  MOD_RES (5)..(5): Any amino acid
NXTPXL

SEQ ID NO: 2235 - protein, 6 aa, Artificial Sequence
  Description of Artificial Sequence: Synthetic peptide
  MOD_RES (2)..(2): Any amino acid
  MOD_RES (5)..(5): Any amino acid
NXTPXR

SEQ ID NO: 2236 - protein, 6 aa, Artificial Sequence
  Description of Artificial Sequence: Synthetic peptide
  MOD_RES (2)..(2): Any amino acid
  MOD_RES (5)..(5): Any amino acid
DXDGXG

SEQ ID NO: 2237 - protein, 6 aa, Artificial Sequence
  Description of Artificial Sequence: Synthetic peptide
  MOD_RES (2)..(2): Any amino acid
  MOD_RES (5)..(5): Any amino acid
DXGTXK

SEQ ID NO: 2238 - protein, 6 aa, Artificial Sequence
  Description of Artificial Sequence: Synthetic peptide
  MOD_RES (2)..(2): Any amino acid
  MOD_RES (5)..(5): Any amino acid
SXGAXW

SEQ ID NO: 2239 - protein, 6 aa, Artificial Sequence
  Description of Artificial Sequence: Synthetic peptide
  MOD_RES (2)..(2): Any amino acid
  MOD_RES (5)..(5): Any amino acid
SXYQXE

SEQ ID NO: 2240 - protein, 6 aa, Artificial Sequence
  Description of Artificial Sequence: Synthetic peptide
  MOD_RES (2)..(2): Any amino acid
  MOD_RES (5)..(5): Any amino acid
KXYRXE

SEQ ID NO: 2241 - protein, 6 aa, Artificial Sequence
  Description of Artificial Sequence: Synthetic peptide
  MOD_RES (2)..(2): Any amino acid
  MOD_RES (5)..(5): Any amino acid
QXKGXG

SEQ ID NO: 2242 - protein, 6 aa, Artificial Sequence
  Description of Artificial Sequence: Synthetic peptide
  MOD_RES (2)..(2): Any amino acid
  MOD_RES (5)..(5): Any amino acid
GXSIXG

SEQ ID NO: 2243 - protein, 6 aa, Artificial Sequence
  Description of Artificial Sequence: Synthetic peptide
  MOD_RES (2)..(2): Any amino acid
  MOD_RES (5)..(5): Any amino acid
AXGVXK

SEQ ID NO: 2244 - protein, 6 aa, Artificial Sequence
  Description of Artificial Sequence: Synthetic peptide
  MOD_RES (2)..(2): Any amino acid
  MOD_RES (5)..(5): Any amino acid
QXGTXK

SEQ ID NO: 2245 - protein, 6 aa, Artificial Sequence
  Description of Artificial Sequence: Synthetic peptide
  MOD_RES (2)..(2): Any amino acid
  MOD_RES (5)..(5): Any amino acid
GXGIXS

SEQ ID NO: 2246 - protein, 6 aa, Artificial Sequence
  Description of Artificial Sequence: Synthetic peptide
  MOD_RES (2)..(2): Any amino acid
  MOD_RES (5)..(5): Any amino acid
FXVAXN

SEQ ID NO: 2247 - protein, 6 aa, Artificial Sequence
  Description of Artificial Sequence: Synthetic peptide
  MOD_RES (2)..(2): Any amino acid
  MOD_RES (5)..(5): Any amino acid
SXKPXY

SEQ ID NO: 2248 - protein, 6 aa, Artificial Sequence
  Description of Artificial Sequence: Synthetic peptide
  MOD_RES (2)..(2): Any amino acid
  MOD_RES (5)..(5): Any amino acid
SXSGXS

SEQ ID NO: 2249 - protein, 6 aa, Artificial Sequence
  Description of Artificial Sequence: Synthetic peptide
  MOD_RES (2)..(2): Any amino acid
  MOD_RES (5)..(5): Any amino acid
CXAGXG

SEQ ID NO: 2250 - protein, 6 aa, Artificial Sequence
  Description of Artificial Sequence: Synthetic peptide
  MOD_RES (2)..(2): Any amino acid
  MOD_RES (5)..(5): Any amino acid
QXSGXT

SEQ ID NO: 2251 - protein, 6 aa, Artificial Sequence
  Description of Artificial Sequence: Synthetic peptide
  MOD_RES (2)..(2): Any amino acid
  MOD_RES (5)..(5): Any amino acid
GXGKXF

SEQ ID NO: 2252 - protein, 6 aa, Artificial Sequence
  Description of Artificial Sequence: Synthetic peptide
  MOD_RES (2)..(2): Any amino acid
  MOD_RES (5)..(5): Any amino acid
LXGAXK

SEQ ID NO: 2253 - protein, 6 aa, Artificial Sequence
  Description of Artificial Sequence: Synthetic peptide
  MOD_RES (2)..(2): Any amino acid
  MOD_RES (5)..(5): Any amino acid
KXQSXQ

SEQ ID NO: 2254 - protein, 6 aa, Artificial Sequence
  Description of Artificial Sequence: Synthetic peptide
  MOD_RES (2)..(2): Any amino acid
  MOD_RES (5)..(5): Any amino acid
DXPEXL

SEQ ID NO: 2255 - protein, 6 aa, Artificial Sequence
  Description of Artificial Sequence: Synthetic peptide
  MOD_RES (2)..(2): Any amino acid
  MOD_RES (5)..(5): Any amino acid
GXCGXC

SEQ ID NO: 2256 - protein, 6 aa, Artificial Sequence
  Description of Artificial Sequence: Synthetic peptide
  MOD_RES (2)..(2): Any amino acid
  MOD_RES (5)..(5): Any amino acid
VXHGXT

SEQ ID NO: 2257 - protein, 6 aa, Artificial Sequence
  Description of Artificial Sequence: Synthetic peptide
  MOD_RES (2)..(2): Any amino acid
  MOD_RES (5)..(5): Any amino acid
GXGKXN

SEQ ID NO: 2258 - protein, 6 aa, Artificial Sequence
  Description of Artificial Sequence: Synthetic peptide
  MOD_RES (2)..(2): Any amino acid
  MOD_RES (5)..(5): Any amino acid
NXGRXV

SEQ ID NO: 2259 - protein, 6 aa, Artificial Sequence
  Description of Artificial Sequence: Synthetic peptide
  MOD_RES (2)..(2): Any amino acid
  MOD_RES (5)..(5): Any amino acid
FXTMXR

SEQ ID NO: 2260 - protein, 6 aa, Artificial Sequence
  Description of Artificial Sequence: Synthetic peptide
  MOD_RES (2)..(2): Any amino acid
  MOD_RES (5)..(5): Any amino acid
KXVAXK

SEQ ID NO: 2261 - protein, 6 aa, Artificial Sequence
  Description of Artificial Sequence: Synthetic peptide
  MOD_RES (2)..(2): Any amino acid
  MOD_RES (5)..(5): Any amino acid
LXNIXR

SEQ ID NO: 2262 - protein, 6 aa, Artificial Sequence
  Description of Artificial Sequence: Synthetic peptide
  MOD_RES (2)..(2): Any amino acid
  MOD_RES (5)..(5): Any amino acid
DXREXG

SEQ ID NO: 2263 - protein, 6 aa, Artificial Sequence
  Description of Artificial Sequence: Synthetic peptide
  MOD_RES (2)..(2): Any amino acid
  MOD_RES (5)..(5): Any amino acid
DXQAXC

SEQ ID NO: 2264 - protein, 6 aa, Artificial Sequence
  Description of Artificial Sequence: Synthetic peptide
  MOD_RES (2)..(2): Any amino acid
  MOD_RES (5)..(5): Any amino acid
NXGSXK

SEQ ID NO: 2265 - protein, 6 aa, Artificial Sequence
  Description of Artificial Sequence: Synthetic peptide
  MOD_RES (2)..(2): Any amino acid
  MOD_RES (5)..(5): Any amino acid
RXVNXT

SEQ ID NO: 2266 - protein, 6 aa, Artificial Sequence
  Description of Artificial Sequence: Synthetic peptide
  MOD_RES (2)..(2): Any amino acid
  MOD_RES (5)..(5): Any amino acid
NXRGXS

SEQ ID NO: 2267 - protein, 6 aa, Artificial Sequence
  Description of Artificial Sequence: Synthetic peptide
  MOD_RES (2)..(2): Any amino acid
  MOD_RES (5)..(5): Any amino acid
RXQGXG

SEQ ID NO: 2268 - protein, 6 aa, Artificial Sequence
  Description of Artificial Sequence: Synthetic peptide
  MOD_RES (2)..(2): Any amino acid
  MOD_RES (5)..(5): Any amino acid
QXQGXG

SEQ ID NO: 2269 - protein, 6 aa, Artificial Sequence
  Description of Artificial Sequence: Synthetic peptide
  MOD_RES (2)..(2): Any amino acid
  MOD_RES (5)..(5): Any amino acid
DXGKXT

SEQ ID NO: 2270 - protein, 6 aa, Artificial Sequence
  Description of Artificial Sequence: Synthetic peptide
  MOD_RES (2)..(2): Any amino acid
  MOD_RES (5)..(5): Any amino acid
GXTGXT

SEQ ID NO: 2271 - protein, 6 aa, Artificial Sequence
  Description of Artificial Sequence: Synthetic peptide
  MOD_RES (2)..(2): Any amino acid
  MOD_RES (5)..(5): Any amino acid
NXGKXS

SEQ ID NO: 2272 - protein, 6 aa, Artificial Sequence
  Description of Artificial Sequence: Synthetic peptide
  MOD_RES (2)..(2): Any amino acid
  MOD_RES (5)..(5): Any amino acid
IXGSXK

SEQ ID NO: 2273 - protein, 6 aa, Artificial Sequence
  Description of Artificial Sequence: Synthetic peptide
  MOD_RES (2)..(2): Any amino acid
  MOD_RES (5)..(5): Any amino acid
PXSLXV

SEQ ID NO: 2274 - protein, 6 aa, Artificial Sequence
  Description of Artificial Sequence: Synthetic peptide
  MOD_RES (2)..(2): Any amino acid
  MOD_RES (5)..(5): Any amino acid
SXVEXT

SEQ ID NO: 2275 - protein, 6 aa, Artificial Sequence
  Description of Artificial Sequence: Synthetic peptide
  MOD_RES (2)..(2): Any amino acid
  MOD_RES (5)..(5): Any amino acid
GXGYXT

SEQ ID NO: 2276 - protein, 6 aa, Artificial Sequence
  Description of Artificial Sequence: Synthetic peptide
  MOD_RES (2)..(2): Any amino acid
  MOD_RES (5)..(5): Any amino acid
TXCGXH

SEQ ID NO: 2277 - protein, 6 aa, Artificial Sequence
  Description of Artificial Sequence: Synthetic peptide
  MOD_RES (2)..(2): Any amino acid
  MOD_RES (5)..(5): Any amino acid
RXRPXN

SEQ ID NO: 2278 - protein, 6 aa, Artificial Sequence
  Description of Artificial Sequence: Synthetic peptide
  MOD_RES (2)..(2): Any amino acid
  MOD_RES (5)..(5): Any amino acid
VXGYXT

SEQ ID NO: 2279 - protein, 6 aa, Artificial Sequence
  Description of Artificial Sequence: Synthetic peptide
  MOD_RES (2)..(2): Any amino acid
  MOD_RES (5)..(5): Any amino acid
RXTGXS

SEQ ID NO: 2280 - protein, 6 aa, Artificial Sequence
  Description of Artificial Sequence: Synthetic peptide
  MOD_RES (2)..(2): Any amino acid
  MOD_RES (5)..(5): Any amino acid
GXGKXC

SEQ ID NO: 2281 - protein, 6 aa, Artificial Sequence
  Description of Artificial Sequence: Synthetic peptide
  MOD_RES (2)..(2): Any amino acid
  MOD_RES (5)..(5): Any amino acid
KXKAXH

SEQ ID NO: 2282 - protein, 6 aa, Artificial Sequence
  Description of Artificial Sequence: Synthetic peptide
  MOD_RES (2)..(2): Any amino acid
  MOD_RES (5)..(5): Any amino acid
DXHDXG

SEQ ID NO: 2283 - protein, 6 aa, Artificial Sequence
  Description of Artificial Sequence: Synthetic peptide
  MOD_RES (2)..(2): Any amino acid
  MOD_RES (5)..(5): Any amino acid
QXGSXW

SEQ ID NO: 2284 - protein, 6 aa, Artificial Sequence
  Description of Artificial Sequence: Synthetic peptide
  MOD_RES (2)..(2): Any amino acid
  MOD_RES (5)..(5): Any amino acid
CXGGXM

SEQ ID NO: 2285 - protein, 6 aa, Artificial Sequence
  Description of Artificial Sequence: Synthetic peptide
  MOD_RES (2)..(2): Any amino acid
  MOD_RES (5)..(5): Any amino acid
NXFCXS

SEQ ID NO: 2286 - protein, 6 aa, Artificial Sequence
  Description of Artificial Sequence: Synthetic peptide
  MOD_RES (2)..(2): Any amino acid
  MOD_RES (5)..(5): Any amino acid
KXSQXK

SEQ ID NO: 2287 - protein, 6 aa, Artificial Sequence
  Description of Artificial Sequence: Synthetic peptide
  MOD_RES (2)..(2): Any amino acid
  MOD_RES (5)..(5): Any amino acid
TXNIXE

SEQ ID NO: 2288 - protein, 6 aa, Artificial Sequence
  Description of Artificial Sequence: Synthetic peptide
  MOD_RES (2)..(2): Any amino acid
  MOD_RES (5)..(5): Any amino acid
NXFTXA

SEQ ID NO: 2289 - protein, 6 aa, Artificial Sequence
  Description of Artificial Sequence: Synthetic peptide
  MOD_RES (2)..(2): Any amino acid
  MOD_RES (5)..(5): Any amino acid
EXGGXW

SEQ ID NO: 2290 - protein, 6 aa, Artificial Sequence
  Description of Artificial Sequence: Synthetic peptide
  MOD_RES (2)..(2): Any amino acid
  MOD_RES (5)..(5): Any amino acid
TXAQXE

SEQ ID NO: 2291 - protein, 6 aa, Artificial Sequence
  Description of Artificial Sequence: Synthetic peptide
  MOD_RES (2)..(2): Any amino acid
  MOD_RES (5)..(5): Any amino acid
TXVFXN

SEQ ID NO: 2292 - protein, 6 aa, Artificial Sequence
  Description of Artificial Sequence: Synthetic peptide
  MOD_RES (2)..(2): Any amino acid
  MOD_RES (5)..(5): Any amino acid
RXDTXQ

SEQ ID NO: 2293 - protein, 6 aa, Artificial Sequence
  Description of Artificial Sequence: Synthetic peptide
  MOD_RES (2)..(2): Any amino acid
  MOD_RES (5)..(5): Any amino acid
DXEGXP

SEQ ID NO: 2294 - protein, 6 aa, Artificial Sequence
  Description of Artificial Sequence: Synthetic peptide
  MOD_RES (2)..(2): Any amino acid
  MOD_RES (5)..(5): Any amino acid
GXGFXL

SEQ ID NO: 2295 - protein, 6 aa, Artificial Sequence
  Description of Artificial Sequence: Synthetic peptide
  MOD_RES (2)..(2): Any amino acid
  MOD_RES (5)..(5): Any amino acid
FXYSXD

SEQ ID NO: 2296 - protein, 6 aa, Artificial Sequence
  Description of Artificial Sequence: Synthetic peptide
  MOD_RES (2)..(2): Any amino acid
SXKVDK

SEQ ID NO: 2297 - protein, 6 aa, Artificial Sequence
  Description of Artificial Sequence: Synthetic peptide
  MOD_RES (2)..(2): Any amino acid
TXVDKK

SEQ ID NO: 2298 - protein, 6 aa, Artificial Sequence
  Description of Artificial Sequence: Synthetic peptide
  MOD_RES (2)..(2): Any amino acid
TXTGKT

SEQ ID NO: 2299 - protein, 6 aa, Artificial Sequence
  Description of Artificial Sequence: Synthetic peptide
  MOD_RES (2)..(2): Any amino acid
DXAGKT

SEQ ID NO: 2300 - protein, 6 aa, Artificial Sequence
  Description of Artificial Sequence: Synthetic peptide
  MOD_RES (2)..(2): Any amino acid
GXGKTT

SEQ ID NO: 2301 - protein, 6 aa, Artificial Sequence
  Description of Artificial Sequence: Synthetic peptide
  MOD_RES (2)..(2): Any amino acid
SXTKVD

SEQ ID NO: 2302 - protein, 6 aa, Artificial Sequence
  Description of Artificial Sequence: Synthetic peptide
  MOD_RES (2)..(2): Any amino acid
GXGKST

SEQ ID NO: 2303 - protein, 6 aa, Artificial Sequence
  Description of Artificial Sequence: Synthetic peptide
  MOD_RES (2)..(2): Any amino acid
VXCKNG

SEQ ID NO: 2304 - protein, 6 aa, Artificial Sequence
  Description of Artificial Sequence: Synthetic peptide
  MOD_RES (2)..(2): Any amino acid
NXKVDK

SEQ ID NO: 2305 - protein, 6 aa, Artificial Sequence
  Description of Artificial Sequence: Synthetic peptide
  MOD_RES (2)..(2): Any amino acid
NXGKTT

SEQ ID NO: 2306 - protein, 6 aa, Artificial Sequence
  Description of Artificial Sequence: Synthetic peptide
  MOD_RES (2)..(2): Any amino acid
DXGVGK

SEQ ID NO: 2307 - protein, 6 aa, Artificial Sequence
  Description of Artificial Sequence: Synthetic peptide
  MOD_RES (2)..(2): Any amino acid
SXTGNT

SEQ ID NO: 2308 - protein, 6 aa, Artificial Sequence
  Description of Artificial Sequence: Synthetic peptide
  MOD_RES (2)..(2): Any amino acid
SXVGKS

SEQ ID NO: 2309 - protein, 6 aa, Artificial Sequence
  Description of Artificial Sequence: Synthetic peptide
  MOD_RES (2)..(2): Any amino acid
CXGNIC

SEQ ID NO: 2310 - protein, 6 aa, Artificial Sequence
  Description of Artificial Sequence: Synthetic peptide
  MOD_RES (2)..(2): Any amino acid
GXGKTS

SEQ ID NO: 2311 - protein, 6 aa, Artificial Sequence
  Description of Artificial Sequence: Synthetic peptide
  MOD_RES (2)..(2): Any amino acid
SXGIGR

SEQ ID NO: 2312 - protein, 6 aa, Artificial Sequence
  Description of Artificial Sequence: Synthetic peptide
  MOD_RES (2)..(2): Any amino acid
YXSGRT

SEQ ID NO: 2313 - protein, 6 aa, Artificial Sequence
  Description of Artificial Sequence: Synthetic peptide
  MOD_RES (2)..(2): Any amino acid
SXGVGR

SEQ ID NO: 2314 - protein, 6 aa, Artificial Sequence
  Description of Artificial Sequence: Synthetic peptide
  MOD_RES (2)..(2): Any amino acid
PXWNIG

SEQ ID NO: 2315 - protein, 6 aa, Artificial Sequence
  Description of Artificial Sequence: Synthetic peptide
  MOD_RES (2)..(2): Any amino acid
GXDVVG

SEQ ID NO: 2316 - protein, 6 aa, Artificial Sequence
  Description of Artificial Sequence: Synthetic peptide
  MOD_RES (2)..(2): Any amino acid
GXGKSA

SEQ ID NO: 2317 - protein, 6 aa, Artificial Sequence
  Description of Artificial Sequence: Synthetic peptide
  MOD_RES (2)..(2): Any amino acid
PXGSGK

SEQ ID NO: 2318 - protein, 6 aa, Artificial Sequence
  Description of Artificial Sequence: Synthetic peptide
  MOD_RES (2)..(2): Any amino acid
CXAGIG

SEQ ID NO: 2319 - protein, 6 aa, Artificial Sequence
  Description of Artificial Sequence: Synthetic peptide
  MOD_RES (2)..(2): Any amino acid
HXASVA

SEQ ID NO: 2320 - protein, 6 aa, Artificial Sequence
  Description of Artificial Sequence: Synthetic peptide
  MOD_RES (2)..(2): Any amino acid
AXKGLV

SEQ ID NO: 2321 - protein, 6 aa, Artificial Sequence
  Description of Artificial Sequence: Synthetic peptide
  MOD_RES (2)..(2): Any amino acid
YXKIHA

SEQ ID NO: 2322 - protein, 6 aa, Artificial Sequence
  Description of Artificial Sequence: Synthetic peptide
  MOD_RES (2)..(2): Any amino acid
RXTTLD

SEQ ID NO: 2323 - protein, 6 aa, Artificial Sequence
  Description of Artificial Sequence: Synthetic peptide
  MOD_RES (2)..(2): Any amino acid
MXYIKI

SEQ ID NO: 2324 - protein, 6 aa, Artificial Sequence
  Description of Artificial Sequence: Synthetic peptide
  MOD_RES (2)..(2): Any amino acid
LXARVK

SEQ ID NO: 2325 - protein, 6 aa, Artificial Sequence
  Description of Artificial Sequence: Synthetic peptide
  MOD_RES (2)..(2): Any amino acid
RXLFLE

SEQ ID NO: 2326 - protein, 6 aa, Artificial Sequence
  Description of Artificial Sequence: Synthetic peptide
  MOD_RES (2)..(2): Any amino acid
GXRDNG

SEQ ID NO: 2327 - protein, 6 aa, Artificial Sequence
  Description of Artificial Sequence: Synthetic peptide
  MOD_RES (2)..(2): Any amino acid
LXNAGK

SEQ ID NO: 2328 - protein, 6 aa, Artificial Sequence
  Description of Artificial Sequence: Synthetic peptide
  MOD_RES (2)..(2): Any amino acid
DXGTGK

SEQ ID NO: 2329 - protein, 6 aa, Artificial Sequence
  Description of Artificial Sequence: Synthetic peptide
  MOD_RES (2)..(2): Any amino acid
SXGIGR

SEQ ID NO: 2330 - protein, 6 aa, Artificial Sequence
  Description of Artificial Sequence: Synthetic peptide
  MOD_RES (2)..(2): Any amino acid
AXGKTT

SEQ ID NO: 2331 - protein, 6 aa, Artificial Sequence
  Description of Artificial Sequence: Synthetic peptide
  MOD_RES (2)..(2): Any amino acid
MXLCTL

SEQ ID NO: 2332 - protein, 6 aa, Artificial Sequence
  Description of Artificial Sequence: Synthetic peptide
  MOD_RES (2)..(2): Any amino acid
KXVACK

SEQ ID NO: 2333 - protein, 6 aa, Artificial Sequence
  Description of Artificial Sequence: Synthetic peptide
  MOD_RES (2)..(2): Any amino acid
QXSGKT

SEQ ID NO: 2334 - protein, 6 aa, Artificial Sequence
  Description of Artificial Sequence: Synthetic peptide
  MOD_RES (2)..(2): Any amino acid
QXGSCW

SEQ ID NO: 2335 - protein, 6 aa, Artificial Sequence
  Description of Artificial Sequence: Synthetic peptide
  MOD_RES (2)..(2): Any amino acid
SXSGKS

SEQ ID NO: 2336 - protein, 6 aa, Artificial Sequence
  Description of Artificial Sequence: Synthetic peptide
  MOD_RES (2)..(2): Any amino acid
MXTFKF

SEQ ID NO: 2337 - protein, 6 aa, Artificial Sequence
  Description of Artificial Sequence: Synthetic peptide
  MOD_RES (2)..(2): Any amino acid
GXTGKT

SEQ ID NO: 2338 - protein, 6 aa, Artificial Sequence
  Description of Artificial Sequence: Synthetic peptide
  MOD_RES (2)..(2): Any amino acid
GXGIMS

SEQ ID NO: 2339 - protein, 6 aa, Artificial Sequence
  Description of Artificial Sequence: Synthetic peptide
  MOD_RES (2)..(2): Any amino acid
NXTPNR

SEQ ID NO: 2340 - protein, 6 aa, Artificial Sequence
  Description of Artificial Sequence: Synthetic peptide
  MOD_RES (2)..(2): Any amino acid
VXHGKT

SEQ ID NO: 2341 - protein, 6 aa, Artificial Sequence
  Description of Artificial Sequence: Synthetic peptide
  MOD_RES (2)..(2): Any amino acid
CXAGVG

SEQ ID NO: 2342 - protein, 6 aa, Artificial Sequence
  Description of Artificial Sequence: Synthetic peptide
  MOD_RES (2)..(2): Any amino acid
AXGVGK

SEQ ID NO: 2343 - protein, 6 aa, Artificial Sequence
  Description of Artificial Sequence: Synthetic peptide
  MOD_RES (2)..(2): Any amino acid
SXGACW

SEQ ID NO: 2344 - protein, 6 aa, Artificial Sequence
  Description of Artificial Sequence: Synthetic peptide
  MOD_RES (2)..(2): Any amino acid
AXNGDS

SEQ ID NO: 2345 - protein, 6 aa, Artificial Sequence
  Description of Artificial Sequence: Synthetic peptide
  MOD_RES (2)..(2): Any amino acid
DXGKTT

SEQ ID NO: 2346 - protein, 6 aa, Artificial Sequence
  Description of Artificial Sequence: Synthetic peptide
  MOD_RES (2)..(2): Any amino acid
LXNICR

SEQ ID NO: 2347 - protein, 6 aa, Artificial Sequence
  Description of Artificial Sequence: Synthetic peptide
  MOD_RES (2)..(2): Any amino acid
CXAGIG

SEQ ID NO: 2348 - protein, 6 aa, Artificial Sequence
  Description of Artificial Sequence: Synthetic peptide
  MOD_RES (2)..(2): Any amino acid
GXGKSS

SEQ ID NO: 2349 - protein, 6 aa, Artificial Sequence
  Description of Artificial Sequence: Synthetic peptide
  MOD_RES (2)..(2): Any amino acid
IXNYTP

SEQ ID NO: 2350 - protein, 6 aa, Artificial Sequence
  Description of Artificial Sequence: Synthetic peptide
  MOD_RES (2)..(2): Any amino acid
NXACKN

SEQ ID NO: 2351 - protein, 6 aa, Artificial Sequence
  Description of Artificial Sequence: Synthetic peptide
  MOD_RES (2)..(2): Any amino acid
NXGSGK

SEQ ID NO: 2352 - protein, 6 aa, Artificial Sequence
  Description of Artificial Sequence: Synthetic peptide
  MOD_RES (2)..(2): Any amino acid
QXGTGK

SEQ ID NO: 2353 - protein, 6 aa, Artificial Sequence
  Description of Artificial Sequence: Synthetic peptide
  MOD_RES (2)..(2): Any amino acid
LXVGMV

SEQ ID NO: 2354 - protein, 6 aa, Artificial Sequence
  Description of Artificial Sequence: Synthetic peptide
  MOD_RES (2)..(2): Any amino acid
YXDNFQ

SEQ ID NO: 2355 - protein, 6 aa, Artificial Sequence
  Description of Artificial Sequence: Synthetic peptide
  MOD_RES (2)..(2): Any amino acid
TXCGVH

SEQ ID NO: 2356 - protein, 6 aa, Artificial Sequence
  Description of Artificial Sequence: Synthetic peptide
  MOD_RES (2)..(2): Any amino acid
GXGKSN

SEQ ID NO: 2357 - protein, 6 aa, Artificial Sequence
  Description of Artificial Sequence: Synthetic peptide
  MOD_RES (2)..(2): Any amino acid
DXHDIG

SEQ ID NO: 2358 - protein, 6 aa, Artificial Sequence
  Description of Artificial Sequence: Synthetic peptide
  MOD_RES (2)..(2): Any amino acid
RXRPFN

SEQ ID NO: 2359 - protein, 6 aa, Artificial Sequence
  Description of Artificial Sequence: Synthetic peptide
  MOD_RES (2)..(2): Any amino acid
NXSGKS

SEQ ID NO: 2360 - protein, 6 aa, Artificial Sequence
  Description of Artificial Sequence: Synthetic peptide
  MOD_RES (2)..(2): Any amino acid
GXGKSC

SEQ ID NO: 2361 - protein, 6 aa, Artificial Sequence
  Description of Artificial Sequence: Synthetic peptide
  MOD_RES (2)..(2): Any amino acid
LXGAGK

SEQ ID NO: 2362 - protein, 6 aa, Artificial Sequence
  Description of Artificial Sequence: Synthetic peptide
  MOD_RES (2)..(2): Any amino acid
TXSGKT

SEQ ID NO: 2363 - protein, 6 aa, Artificial Sequence
  Description of Artificial Sequence: Synthetic peptide
  MOD_RES (2)..(2): Any amino acid
RXVNYT

SEQ ID NO: 2364 - protein, 6 aa, Artificial Sequence
  Description of Artificial Sequence: Synthetic peptide
  MOD_RES (2)..(2): Any amino acid
GXVGKS

SEQ ID NO: 2365 - protein, 6 aa, Artificial Sequence
  Description of Artificial Sequence: Synthetic peptide
  MOD_RES (2)..(2): Any amino acid
TXNIGE

SEQ ID NO: 2366 - protein, 6 aa, Artificial Sequence
  Description of Artificial Sequence: Synthetic peptide
  MOD_RES (2)..(2): Any amino acid
PXVGKS

SEQ ID NO: 2367 - protein, 6 aa, Artificial Sequence
  Description of Artificial Sequence: Synthetic peptide
  MOD_RES (2)..(2): Any amino acid
KXYRME

SEQ ID NO: 2368 - protein, 6 aa, Artificial Sequence
  Description of Artificial Sequence: Synthetic peptide
  MOD_RES (2)..(2): Any amino acid
GXGLGR

SEQ ID NO: 2369 - protein, 6 aa, Artificial Sequence
  Description of Artificial Sequence: Synthetic peptide
  MOD_RES (2)..(2): Any amino acid
QXQGIM

SEQ ID NO: 2370 - protein, 6 aa, Artificial Sequence
  Description of Artificial Sequence: Synthetic peptide
  MOD_RES (2)..(2): Any amino acid
KXQSPQ

SEQ ID NO: 2371 - protein, 6 aa, Artificial Sequence
  Description of Artificial Sequence: Synthetic peptide
  MOD_RES (2)..(2): Any amino acid
QXRGYG

SEQ ID NO: 2372 - protein, 6 aa, Artificial Sequence
  Description of Artificial Sequence: Synthetic peptide
  MOD_RES (2)..(2): Any amino acid
NXGKST

SEQ ID NO: 2373 - protein, 6 aa, Artificial Sequence
  Description of Artificial Sequence: Synthetic peptide
  MOD_RES (2)..(2): Any amino acid
GXGKTF

SEQ ID NO: 2374 - protein, 6 aa, Artificial Sequence
  Description of Artificial Sequence: Synthetic peptide
  MOD_RES (2)..(2): Any amino acid
SXVGKT

SEQ ID NO: 2375 - protein, 6 aa, Artificial Sequence
  Description of Artificial Sequence: Synthetic peptide
  MOD_RES (2)..(2): Any amino acid
NXFCGS

SEQ ID NO: 2376 - protein, 6 aa, Artificial Sequence
  Description of Artificial Sequence: Synthetic peptide
  MOD_RES (2)..(2): Any amino acid
NXFTVA

SEQ ID NO: 2377 - protein, 6 aa, Artificial Sequence
  Description of Artificial Sequence: Synthetic peptide
  MOD_RES (2)..(2): Any amino acid
GXTVEK

SEQ ID NO: 2378 - protein, 6 aa, Artificial Sequence
  Description of Artificial Sequence: Synthetic peptide
  MOD_RES (2)..(2): Any amino acid
WXHGYA

SEQ ID NO: 2379 - protein, 6 aa, Artificial Sequence
  Description of Artificial Sequence: Synthetic peptide
  MOD_RES (2)..(2): Any amino acid
KXKACH

SEQ ID NO: 2380 - protein, 6 aa, Artificial Sequence
  Description of Artificial Sequence: Synthetic peptide
  MOD_RES (2)..(2): Any amino acid
KXSQQK

SEQ ID NO: 2381 - protein, 6 aa, Artificial Sequence
  Description of Artificial Sequence: Synthetic peptide
  MOD_RES (2)..(2): Any amino acid
EXTFPD

SEQ ID NO: 2382 - protein, 6 aa, Artificial Sequence
  Description of Artificial Sequence: Synthetic peptide
  MOD_RES (2)..(2): Any amino acid
VXFTFP

SEQ ID NO: 2383 - protein, 6 aa, Artificial Sequence
  Description of Artificial Sequence: Synthetic peptide
  MOD_RES (2)..(2): Any amino acid
VXWGRG

SEQ ID NO: 2384 - protein, 6 aa, Artificial Sequence
  Description of Artificial Sequence: Synthetic peptide
  MOD_RES (2)..(2): Any amino acid
GXGYAT

SEQ ID NO: 2385 - protein, 6 aa, Artificial Sequence
  Description of Artificial Sequence: Synthetic peptide
  MOD_RES (2)..(2): Any amino acid
IXGSGK

SEQ ID NO: 2386 - protein, 6 aa, Artificial Sequence
  Description of Artificial Sequence: Synthetic peptide
  MOD_RES (2)..(2): Any amino acid
DXRETG

SEQ ID NO: 2387 - protein, 6 aa, Artificial Sequence
  Description of Artificial Sequence: Synthetic peptide
  MOD_RES (2)..(2): Any amino acid
GXGKGT

SEQ ID NO: 2388 - protein, 6 aa, Artificial Sequence
  Description of Artificial Sequence: Synthetic peptide
  MOD_RES (2)..(2): Any amino acid
SXGAGK

SEQ ID NO: 2389 - protein, 6 aa, Artificial Sequence
  Description of Artificial Sequence: Synthetic peptide
  MOD_RES (2)..(2): Any amino acid
VXGYGT

SEQ ID NO: 2390 - protein, 6 aa, Artificial Sequence
  Description of Artificial Sequence: Synthetic peptide
  MOD_RES (2)..(2): Any amino acid
SXKPLY

SEQ ID NO: 2391 - protein, 6 aa, Artificial Sequence
  Description of Artificial Sequence: Synthetic peptide
  MOD_RES (2)..(2): Any amino acid
HXDHGK

SEQ ID NO: 2392 - protein, 6 aa, Artificial Sequence
  Description of Artificial Sequence: Synthetic peptide
  MOD_RES (2)..(2): Any amino acid
QXRGLG

SEQ ID NO: 2393 - protein, 6 aa, Artificial Sequence
  Description of Artificial Sequence: Synthetic peptide
  MOD_RES (2)..(2): Any amino acid
GXGFSI

SEQ ID NO: 2394 - protein, 6 aa, Artificial Sequence
  Description of Artificial Sequence: Synthetic peptide
  MOD_RES (2)..(2): Any amino acid
IXGNSA

SEQ ID NO: 2395 - protein, 6 aa, Artificial Sequence
  Description of Artificial Sequence: Synthetic peptide
  MOD_RES (3)..(5): Any amino acid
GLXXXQ

SEQ ID NO: 2396 - protein, 6 aa, Artificial Sequence
  Description of Artificial Sequence: Synthetic peptide
  MOD_RES (3)..(5): Any amino acid
EVXXXW

SEQ ID NO: 2397 - protein, 6 aa, Artificial Sequence
  Description of Artificial Sequence: Synthetic peptide
  MOD_RES (3)..(5): Any amino acid
GIXXXQ

SEQ ID NO: 2398 - protein, 6 aa, Artificial Sequence
  Description of Artificial Sequence: Synthetic peptide
  MOD_RES (3)..(5): Any amino acid
STXXXK

SEQ ID NO: 2399 - protein, 6 aa, Artificial Sequence
  Description of Artificial Sequence: Synthetic peptide
  MOD_RES (3)..(5): Any amino acid
LSXXXH

SEQ ID NO: 2400 - protein, 6 aa, Artificial Sequence
  Description of Artificial Sequence: Synthetic peptide
  MOD_RES (3)..(5): Any amino acid
GSXXXT

SEQ ID NO: 2401 - protein, 6 aa, Artificial Sequence
  Description of Artificial Sequence: Synthetic peptide
  MOD_RES (3)..(5): Any amino acid
NPXXXE

SEQ ID NO: 2402 - protein, 6 aa, Artificial Sequence
  Description of Artificial Sequence: Synthetic peptide
  MOD_RES (3)..(5): Any amino acid
GLXXXE

SEQ ID NO: 2403 - protein, 6 aa, Artificial Sequence
  Description of Artificial Sequence: Synthetic peptide
  MOD_RES (3)..(5): Any amino acid
TQXXXT

SEQ ID NO: 2404 - protein, 6 aa, Artificial Sequence
  Description of Artificial Sequence: Synthetic peptide
  MOD_RES (3)..(5): Any amino acid
GFXXXD

SEQ ID NO: 2405 - protein, 6 aa, Artificial Sequence
  Description of Artificial Sequence: Synthetic peptide
  MOD_RES (3)..(5): Any amino acid
GGXXXN

SEQ ID NO: 2406 - protein, 6 aa, Artificial Sequence
  Description of Artificial Sequence: Synthetic peptide
  MOD_RES (3)..(5): Any amino acid
CSXXXG

SEQ ID NO: 2407 - protein, 6 aa, Artificial Sequence
  Description of Artificial Sequence: Synthetic peptide
  MOD_RES (3)..(5): Any amino acid
VAXXXG

SEQ ID NO: 2408 - protein, 6 aa, Artificial Sequence
  Description of Artificial Sequence: Synthetic peptide
  MOD_RES (3)..(5): Any amino acid
LPXXXR

SEQ ID NO: 2409 - protein, 6 aa, Artificial Sequence
  Description of Artificial Sequence: Synthetic peptide
  MOD_RES (3)..(5): Any amino acid
SLXXXE

SEQ ID NO: 2410 - protein, 6 aa, Artificial Sequence
  Description of Artificial Sequence: Synthetic peptide
  MOD_RES (3)..(5): Any amino acid
GVXXXE

SEQ ID NO: 2411 - protein, 6 aa, Artificial Sequence
  Description of Artificial Sequence: Synthetic peptide
  MOD_RES (3)..(5): Any amino acid
KEXXXA

SEQ ID NO: 2412 - protein, 6 aa, Artificial Sequence
  Description of Artificial Sequence: Synthetic peptide
  MOD_RES (3)..(5): Any amino acid
CKXXXT

SEQ ID NO: 2413 - protein, 6 aa, Artificial Sequence
  Description of Artificial Sequence: Synthetic peptide
  MOD_RES (3)..(5): Any amino acid
LSXXXQ

SEQ ID NO: 2414 - protein, 6 aa, Artificial Sequence
  Description of Artificial Sequence: Synthetic peptide
  MOD_RES (3)..(5): Any amino acid
TGXXXT

SEQ ID NO: 2415 - protein, 6 aa, Artificial Sequence
  Description of Artificial Sequence: Synthetic peptide
  MOD_RES (3)..(5): Any amino acid
LSXXXR

SEQ ID NO: 2416 - protein, 6 aa, Artificial Sequence
  Description of Artificial Sequence: Synthetic peptide
  MOD_RES (3)..(5): Any amino acid
DLXXXE

SEQ ID NO: 2417 - protein, 6 aa, Artificial Sequence
  Description of Artificial Sequence: Synthetic peptide
  MOD_RES (3)..(5): Any amino acid
FSXXXY

SEQ ID NO: 2418 - protein, 6 aa, Artificial Sequence
  Description of Artificial Sequence: Synthetic peptide
  MOD_RES (3)..(5): Any amino acid
NMXXXE

SEQ ID NO: 2419 - protein, 6 aa, Artificial Sequence
  Description of Artificial Sequence: Synthetic peptide
  MOD_RES (3)..(5): Any amino acid
LTXXXR

SEQ ID NO: 2420 - protein, 6 aa, Artificial Sequence
  Description of Artificial Sequence: Synthetic peptide
  MOD_RES (3)..(5): Any amino acid
YAXXXT

SEQ ID NO: 2421 - protein, 6 aa, Artificial Sequence
  Description of Artificial Sequence: Synthetic peptide
  MOD_RES (3)..(5): Any amino acid
LTXXXK

SEQ ID NO: 2422 - protein, 6 aa, Artificial Sequence
  Description of Artificial Sequence: Synthetic peptide
  MOD_RES (3)..(5): Any amino acid
QSXXXL

SEQ ID NO: 2423 - protein, 6 aa, Artificial Sequence
  Description of Artificial Sequence: Synthetic peptide
  MOD_RES (3)..(5): Any amino acid
ERXXXD

SEQ ID NO: 2424 - protein, 6 aa, Artificial Sequence
  Description of Artificial Sequence: Synthetic peptide
  MOD_RES (3)..(5): Any amino acid
LDXXXR

SEQ ID NO: 2425 - protein, 6 aa, Artificial Sequence
  Description of Artificial Sequence: Synthetic peptide
  MOD_RES (3)..(5): Any amino acid
TKXXXC

SEQ ID NO: 2426 - protein, 6 aa, Artificial Sequence
  Description of Artificial Sequence: Synthetic peptide
  MOD_RES (3)..(5): Any amino acid
CEXXXY

SEQ ID NO: 2427 - protein, 6 aa, Artificial Sequence
  Description of Artificial Sequence: Synthetic peptide
  MOD_RES (3)..(5): Any amino acid
SWXXXC

SEQ ID NO: 2428 - protein, 6 aa, Artificial Sequence
  Description of Artificial Sequence: Synthetic peptide
  MOD_RES (3)..(5): Any amino acid
SAXXXR

SEQ ID NO: 2429 - protein, 6 aa, Artificial Sequence
  Description of Artificial Sequence: Synthetic peptide
  MOD_RES (3)..(5): Any amino acid
VQXXXS

SEQ ID NO: 2430 - protein, 6 aa, Artificial Sequence
  Description of Artificial Sequence: Synthetic peptide
  MOD_RES (3)..(5): Any amino acid
NLXXXD

SEQ ID NO: 2431 - protein, 6 aa, Artificial Sequence
  Description of Artificial Sequence: Synthetic peptide
  MOD_RES (3)..(5): Any amino acid
ELXXXE

SEQ ID NO: 2432 - protein, 6 aa, Artificial Sequence
  Description of Artificial Sequence: Synthetic peptide
  MOD_RES (3)..(5): Any amino acid
GVXXXA

SEQ ID NO: 2433 - protein, 6 aa, Artificial Sequence
  Description of Artificial Sequence: Synthetic peptide
  MOD_RES (3)..(5): Any amino acid
YHXXXE

SEQ ID NO: 2434 - protein, 6 aa, Artificial Sequence
  Description of Artificial Sequence: Synthetic peptide
  MOD_RES (3)..(5): Any amino acid
TVXXXE

SEQ ID NO: 2435 - protein, 6 aa, Artificial Sequence
  Description of Artificial Sequence: Synthetic peptide
  MOD_RES (3)..(5): Any amino acid
SAXXXR

SEQ ID NO: 2436 - protein, 6 aa, Artificial Sequence
  Description of Artificial Sequence: Synthetic peptide
  MOD_RES (3)..(5): Any amino acid
PTXXXG

SEQ ID NO: 2437 - protein, 6 aa, Artificial Sequence
  Description of Artificial Sequence: Synthetic peptide
  MOD_RES (3)..(5): Any amino acid
QTXXXK

SEQ ID NO: 2438 - protein, 6 aa, Artificial Sequence
  Description of Artificial Sequence: Synthetic peptide
  MOD_RES (3)..(5): Any amino acid
TKXXXK

SEQ ID NO: 2439 - protein, 6 aa, Artificial Sequence
  Description of Artificial Sequence: Synthetic peptide
  MOD_RES (3)..(5): Any amino acid
GAXXXT

SEQ ID NO: 2440 - protein, 6 aa, Artificial Sequence
  Description of Artificial Sequence: Synthetic peptide
  MOD_RES (3)..(5): Any amino acid
LSXXXK

SEQ ID NO: 2441 - protein, 6 aa, Artificial Sequence
  Description of Artificial Sequence: Synthetic peptide
  MOD_RES (3)..(5): Any amino acid
GYXXXN

SEQ ID NO: 2442 - protein, 6 aa, Artificial Sequence
  Description of Artificial Sequence: Synthetic peptide
  MOD_RES (3)..(5): Any amino acid
NTXXXK

SEQ ID NO: 2443 - protein, 6 aa, Artificial Sequence
  Description of Artificial Sequence: Synthetic peptide
  MOD_RES (3)..(5): Any amino acid
DNXXXP

SEQ ID NO: 2444 - protein, 6 aa, Artificial Sequence
  Description of Artificial Sequence: Synthetic peptide
  MOD_RES (3)..(5): Any amino acid
WLXXXH

SEQ ID NO: 2445 - protein, 6 aa, Artificial Sequence
  Description of Artificial Sequence: Synthetic peptide
  MOD_RES (3)..(5): Any amino acid
RAXXXR

SEQ ID NO: 2446 - protein, 6 aa, Artificial Sequence
  Description of Artificial Sequence: Synthetic peptide
  MOD_RES (3)..(5): Any amino acid
EAXXXE

SEQ ID NO: 2447 - protein, 6 aa, Artificial Sequence
  Description of Artificial Sequence: Synthetic peptide
  MOD_RES (3)..(5): Any amino acid
GLXXXI

SEQ ID NO: 2448 - protein, 6 aa, Artificial Sequence
  Description of Artificial Sequence: Synthetic peptide
  MOD_RES (3)..(5): Any amino acid
ACXXXS

SEQ ID NO: 2449 - protein, 6 aa, Artificial Sequence
  Description of Artificial Sequence: Synthetic peptide
  MOD_RES (3)..(5): Any amino acid
GVXXXD

SEQ ID NO: 2450 - protein, 6 aa, Artificial Sequence
  Description of Artificial Sequence: Synthetic peptide
  MOD_RES (3)..(5): Any amino acid
LSXXXI

SEQ ID NO: 2451 - protein, 6 aa, Artificial Sequence
  Description of Artificial Sequence: Synthetic peptide
  MOD_RES (3)..(5): Any amino acid
QTXXXK

SEQ ID NO: 2452 - protein, 6 aa, Artificial Sequence
  Description of Artificial Sequence: Synthetic peptide
  MOD_RES (3)..(5): Any amino acid
SSXXXD

SEQ ID NO: 2453 - protein, 6 aa, Artificial Sequence
  Description of Artificial Sequence: Synthetic peptide
  MOD_RES (3)..(5): Any amino acid
GVXXXQ

SEQ ID NO: 2454 - protein, 6 aa, Artificial Sequence
  Description of Artificial Sequence: Synthetic peptide
  MOD_RES (3)..(5): Any amino acid
NAXXXQ

SEQ ID NO: 2455 - protein, 6 aa, Artificial Sequence
  Description of Artificial Sequence: Synthetic peptide
  MOD_RES (3)..(5): Any amino acid
CHXXXR

SEQ ID NO: 2456 - protein, 6 aa, Artificial Sequence
  Description of Artificial Sequence: Synthetic peptide
  MOD_RES (3)..(5): Any amino acid
GVXXXS

SEQ ID NO: 2457 - protein, 6 aa, Artificial Sequence
  Description of Artificial Sequence: Synthetic peptide
  MOD_RES (3)..(5): Any amino acid
GRXXXE

SEQ ID NO: 2458 - protein, 6 aa, Artificial Sequence
  Description of Artificial Sequence: Synthetic peptide
  MOD_RES (3)..(5): Any amino acid
PGXXXL

SEQ ID NO: 2459 - protein, 6 aa, Artificial Sequence
  Description of Artificial Sequence: Synthetic peptide
  MOD_RES (3)..(5): Any amino acid
SAXXXK

SEQ ID NO: 2460 - protein, 6 aa, Artificial Sequence
  Description of Artificial Sequence: Synthetic peptide
  MOD_RES (3)..(5): Any amino acid
AAXXXT

SEQ ID NO: 2461 - protein, 6 aa, Artificial Sequence
  Description of Artificial Sequence: Synthetic peptide
  MOD_RES (3)..(5): Any amino acid
FPXXXT

SEQ ID NO: 2462 - protein, 6 aa, Artificial Sequence
  Description of Artificial Sequence: Synthetic peptide
  MOD_RES (3)..(5): Any amino acid
REXXXR

SEQ ID NO: 2463 - protein, 6 aa, Artificial Sequence
  Description of Artificial Sequence: Synthetic peptide
  MOD_RES (3)..(5): Any amino acid
HLXXXH

SEQ ID NO: 2464 - protein, 6 aa, Artificial Sequence
  Description of Artificial Sequence: Synthetic peptide
  MOD_RES (3)..(5): Any amino acid
EFXXXD

SEQ ID NO: 2465 - protein, 6 aa, Artificial Sequence
  Description of Artificial Sequence: Synthetic peptide
  MOD_RES (3)..(5): Any amino acid
SGXXXD

SEQ ID NO: 2466 - protein, 6 aa, Artificial Sequence
  Description of Artificial Sequence: Synthetic peptide
  MOD_RES (3)..(5): Any amino acid
FTXXXN

SEQ ID NO: 2467 - protein, 6 aa, Artificial Sequence
  Description of Artificial Sequence: Synthetic peptide
  MOD_RES (3)..(5): Any amino acid
RIXXXQ

SEQ ID NO: 2468 - protein, 6 aa, Artificial Sequence
  Description of Artificial Sequence: Synthetic peptide
  MOD_RES (3)..(5): Any amino acid
QCXXXH

SEQ ID NO: 2469 - protein, 6 aa, Artificial Sequence
  Description of Artificial Sequence: Synthetic peptide
  MOD_RES (3)..(5): Any amino acid
GFXXXG

SEQ ID NO: 2470 - protein, 6 aa, Artificial Sequence
  Description of Artificial Sequence: Synthetic peptide
  MOD_RES (3)..(5): Any amino acid
CLXXXC

SEQ ID NO: 2471 - protein, 6 aa, Artificial Sequence
  Description of Artificial Sequence: Synthetic peptide
  MOD_RES (3)..(5): Any amino acid
TCXXXH

SEQ ID NO: 2472 - protein, 6 aa, Artificial Sequence
  Description of Artificial Sequence: Synthetic peptide
  MOD_RES (3)..(5): Any amino acid
TAXXXE

SEQ ID NO: 2473 - protein, 6 aa, Artificial Sequence
  Description of Artificial Sequence: Synthetic peptide
  MOD_RES (3)..(5): Any amino acid
PTXXXL

SEQ ID NO: 2474 - protein, 6 aa, Artificial Sequence
  Description of Artificial Sequence: Synthetic peptide
  MOD_RES (3)..(5): Any amino acid
LDXXXK

SEQ ID NO: 2475 - protein, 6 aa, Artificial Sequence
  Description of Artificial Sequence: Synthetic peptide
  MOD_RES (3)..(5): Any amino acid
AEXXXV

SEQ ID NO: 2476 - protein, 6 aa, Artificial Sequence
  Description of Artificial Sequence: Synthetic peptide
  MOD_RES (3)..(5): Any amino acid
KCXXXH

SEQ ID NO: 2477 - protein, 6 aa, Artificial Sequence
  Description of Artificial Sequence: Synthetic peptide
  MOD_RES (3)..(5): Any amino acid
LHXXXL

SEQ ID NO: 2478 - protein, 6 aa, Artificial Sequence
  Description of Artificial Sequence: Synthetic peptide
  MOD_RES (3)..(5): Any amino acid
EAXXXQ

SEQ ID NO: 2479 - protein, 6 aa, Artificial Sequence
  Description of Artificial Sequence: Synthetic peptide
  MOD_RES (3)..(5): Any amino acid
SPXXXS

SEQ ID NO: 2480 - protein, 6 aa, Artificial Sequence
  Description of Artificial Sequence: Synthetic peptide
  MOD_RES (3)..(5): Any amino acid
TPXXXK

SEQ ID NO: 2481 - protein, 6 aa, Artificial Sequence
  Description of Artificial Sequence: Synthetic peptide
  MOD_RES (3)..(5): Any amino acid
GAXXXE

SEQ ID NO: 2482 - protein, 6 aa, Artificial Sequence
  Description of Artificial Sequence: Synthetic peptide
  MOD_RES (3)..(5): Any amino acid
SGXXXS

SEQ ID NO: 2483 - protein, 6 aa, Artificial Sequence
  Description of Artificial Sequence: Synthetic peptide
  MOD_RES (3)..(5): Any amino acid
EGXXXE

SEQ ID NO: 2484 - protein, 6 aa, Artificial Sequence
  Description of Artificial Sequence: Synthetic peptide
  MOD_RES (3)..(5): Any amino acid
GIXXXE

SEQ ID NO: 2485 - protein, 6 aa, Artificial Sequence
  Description of Artificial Sequence: Synthetic peptide
  MOD_RES (3)..(5): Any amino acid
GQXXXK

SEQ ID NO: 2486 - protein, 6 aa, Artificial Sequence
  Description of Artificial Sequence: Synthetic peptide
  MOD_RES (3)..(5): Any amino acid
DSXXXR

SEQ ID NO: 2487 - protein, 6 aa, Artificial Sequence
  Description of Artificial Sequence: Synthetic peptide
  MOD_RES (3)..(5): Any amino acid
FPXXXA

SEQ ID NO: 2488 - protein, 6 aa, Artificial Sequence
  Description of Artificial Sequence: Synthetic peptide
  MOD_RES (3)..(5): Any amino acid
GEXXXQ

SEQ ID NO: 2489 - protein, 6 aa, Artificial Sequence
  Description of Artificial Sequence: Synthetic peptide
  MOD_RES (3)..(5): Any amino acid
TQXXXS

SEQ ID NO: 2490 - protein, 6 aa, Artificial Sequence
  Description of Artificial Sequence: Synthetic peptide
  MOD_RES (3)..(5): Any amino acid
SAXXXR

SEQ ID NO: 2491 - protein, 6 aa, Artificial Sequence
  Description of Artificial Sequence: Synthetic peptide
  MOD_RES (3)..(5): Any amino acid
DKXXXP

SEQ ID NO: 2492 - protein, 6 aa, Artificial Sequence
  Description of Artificial Sequence: Synthetic peptide
  MOD_RES (3)..(5): Any amino acid
KLXXXE

SEQ ID NO: 2493 - protein, 6 aa, Artificial Sequence
  Description of Artificial Sequence: Synthetic peptide
  MOD_RES (3)..(5): Any amino acid
GIXXXT

SEQ ID NO: 2494 - protein, 6 aa, Artificial Sequence
  Description of Artificial Sequence: Synthetic peptide
  MOD_RES (3)..(4): Any amino acid
STXXDK

SEQ ID NO: 2495 - protein, 6 aa, Artificial Sequence
  Description of Artificial Sequence: Synthetic peptide
  MOD_RES (3)..(4): Any amino acid
SAXXGR

SEQ ID NO: 2496 - protein, 6 aa, Artificial Sequence
  Description of Artificial Sequence: Synthetic peptide
  MOD_RES (3)..(4): Any amino acid
TKXXKK

SEQ ID NO: 2497 - protein, 6 aa, Artificial Sequence
  Description of Artificial Sequence: Synthetic peptide
  MOD_RES (3)..(4): Any amino acid
TQXXKT

SEQ ID NO: 2498 - protein, 6 aa, Artificial Sequence
  Description of Artificial Sequence: Synthetic peptide
  MOD_RES (3)..(4): Any amino acid
ERXXMD

SEQ ID NO: 2499 - protein, 6 aa, Artificial Sequence
  Description of Artificial Sequence: Synthetic peptide
  MOD_RES (3)..(4): Any amino acid
PTXXIG

SEQ ID NO: 2500 - protein, 6 aa, Artificial Sequence
  Description of Artificial Sequence: Synthetic peptide
  MOD_RES (3)..(4): Any amino acid
SAXXGR

SEQ ID NO: 2501 - protein, 6 aa, Artificial Sequence
  Description of Artificial Sequence: Synthetic peptide
  MOD_RES (3)..(4): Any amino acid
LSXXYH

SEQ ID NO: 2502 - protein, 6 aa, Artificial Sequence
  Description of Artificial Sequence: Synthetic peptide
  MOD_RES (3)..(4): Any amino acid
GSXXST

SEQ ID NO: 2503 - protein, 6 aa, Artificial Sequence
  Description of Artificial Sequence: Synthetic peptide
  MOD_RES (3)..(4): Any amino acid
YAXXRT

SEQ ID NO: 2504 - protein, 6 aa, Artificial Sequence
  Description of Artificial Sequence: Synthetic peptide
  MOD_RES (3)..(4): Any amino acid
CSXXIG

SEQ ID NO: 2505 - protein, 6 aa, Artificial Sequence
  Description of Artificial Sequence: Synthetic peptide
  MOD_RES (3)..(4): Any amino acid
TGXXKT

SEQ ID NO: 2506 - protein, 6 aa, Artificial Sequence
  Description of Artificial Sequence: Synthetic peptide
  MOD_RES (3)..(4): Any amino acid
TEXXSI

SEQ ID NO: 2507 - protein, 6 aa, Artificial Sequence
  Description of Artificial Sequence: Synthetic peptide
  MOD_RES (3)..(4): Any amino acid
CSXXVG

SEQ ID NO: 2508 - protein, 6 aa, Artificial Sequence
  Description of Artificial Sequence: Synthetic peptide
  MOD_RES (3)..(4): Any amino acid
QSXXSL

SEQ ID NO: 2509 - protein, 6 aa, Artificial Sequence
  Description of Artificial Sequence: Synthetic peptide
  MOD_RES (3)..(4): Any amino acid
NAXXQV

SEQ ID NO: 2510 - protein, 6 aa, Artificial Sequence
  Description of Artificial Sequence: Synthetic peptide
  MOD_RES (3)..(4): Any amino acid
QLXXRQ

SEQ ID NO: 2511 - protein, 6 aa, Artificial Sequence
  Description of Artificial Sequence: Synthetic peptide
  MOD_RES (3)..(4): Any amino acid
ERXXAM

SEQ ID NO: 2512 - protein, 6 aa, Artificial Sequence
  Description of Artificial Sequence: Synthetic peptide
  MOD_RES (3)..(4): Any amino acid
LLXXDN

SEQ ID NO: 2513 - protein, 6 aa, Artificial Sequence
  Description of Artificial Sequence: Synthetic peptide
  MOD_RES (3)..(4): Any amino acid
DDXXFV

SEQ ID NO: 2514 - protein, 6 aa, Artificial Sequence
  Description of Artificial Sequence: Synthetic peptide
  MOD_RES (3)..(4): Any amino acid
GSXXAE

SEQ ID NO: 2515 - protein, 6 aa, Artificial Sequence
  Description of Artificial Sequence: Synthetic peptide
  MOD_RES (3)..(4): Any amino acid
ITXXVF

SEQ ID NO: 2516 - protein, 6 aa, Artificial Sequence
  Description of Artificial Sequence: Synthetic peptide
  MOD_RES (3)..(4): Any amino acid
SSXXVD

SEQ ID NO: 2517 - protein, 6 aa, Artificial Sequence
  Description of Artificial Sequence: Synthetic peptide
  MOD_RES (3)..(4): Any amino acid
QGXXLG

SEQ ID NO: 2518 - protein, 6 aa, Artificial Sequence
  Description of Artificial Sequence: Synthetic peptide
  MOD_RES (3)..(4): Any amino acid
RIXXNL

SEQ ID NO: 2519 - protein, 6 aa, Artificial Sequence
  Description of Artificial Sequence: Synthetic peptide
  MOD_RES (3)..(4): Any amino acid
CHXXYR

SEQ ID NO: 2520 - protein, 6 aa, Artificial Sequence
  Description of Artificial Sequence: Synthetic peptide
  MOD_RES (3)..(4): Any amino acid
VAXXNG

SEQ ID NO: 2521 - protein, 6 aa, Artificial Sequence
  Description of Artificial Sequence: Synthetic peptide
  MOD_RES (3)..(4): Any amino acid
LDXXGK

SEQ ID NO: 2522 - protein, 6 aa, Artificial Sequence
  Description of Artificial Sequence: Synthetic peptide
  MOD_RES (3)..(4): Any amino acid
SWXXGC

SEQ ID NO: 2523 - protein, 6 aa, Artificial Sequence
  Description of Artificial Sequence: Synthetic peptide
  MOD_RES (3)..(4): Any amino acid
SGXXKS

SEQ ID NO: 2524 - protein, 6 aa, Artificial Sequence
  Description of Artificial Sequence: Synthetic peptide
  MOD_RES (3)..(4): Any amino acid
WKXXFT

SEQ ID NO: 2525 - protein, 6 aa, Artificial Sequence
  Description of Artificial Sequence: Synthetic peptide
  MOD_RES (3)..(4): Any amino acid
QTXXGK

SEQ ID NO: 2526 - protein, 6 aa, Artificial Sequence
  Description of Artificial Sequence: Synthetic peptide
  MOD_RES (3)..(4): Any amino acid
NTXXDK

SEQ ID NO: 2527 - protein, 6 aa, Artificial Sequence
  Description of Artificial Sequence: Synthetic peptide
  MOD_RES (3)..(4): Any amino acid
RMXXFK

SEQ ID NO: 2528 - protein, 6 aa, Artificial Sequence
  Description of Artificial Sequence: Synthetic peptide
  MOD_RES (3)..(4): Any amino acid
KCXXCH

SEQ ID NO: 2529 - protein, 6 aa, Artificial Sequence
  Description of Artificial Sequence: Synthetic peptide
  MOD_RES (3)..(4): Any amino acid
LGXXIV

SEQ ID NO: 2530 - protein, 6 aa, Artificial Sequence
  Description of Artificial Sequence: Synthetic peptide
  MOD_RES (3)..(4): Any amino acid
CLXXIC

SEQ ID NO: 2531 - protein, 6 aa, Artificial Sequence
  Description of Artificial Sequence: Synthetic peptide
  MOD_RES (3)..(4): Any amino acid
YHXXNE

SEQ ID NO: 2532 - protein, 6 aa, Artificial Sequence
  Description of Artificial Sequence: Synthetic peptide
  MOD_RES (3)..(4): Any amino acid
LVXXHE

SEQ ID NO: 2533 - protein, 6 aa, Artificial Sequence
  Description of Artificial Sequence: Synthetic peptide
  MOD_RES (3)..(4): Any amino acid
IVXXTP

SEQ ID NO: 2534 - protein, 6 aa, Artificial Sequence
  Description of Artificial Sequence: Synthetic peptide
  MOD_RES (3)..(4): Any amino acid
LDXXGK

SEQ ID NO: 2535 - protein, 6 aa, Artificial Sequence
  Description of Artificial Sequence: Synthetic peptide
  MOD_RES (3)..(4): Any amino acid
GKXXAH

SEQ ID NO: 2536 - protein, 6 aa, Artificial Sequence
  Description of Artificial Sequence: Synthetic peptide
  MOD_RES (3)..(4): Any amino acid
DNXXKT

SEQ ID NO: 2537 - protein, 6 aa, Artificial Sequence
  Description of Artificial Sequence: Synthetic peptide
  MOD_RES (3)..(4): Any amino acid
CSXXIG

SEQ ID NO: 2538 - protein, 6 aa, Artificial Sequence
  Description of Artificial Sequence: Synthetic peptide
  MOD_RES (3)..(4): Any amino acid
ATXXRV

SEQ ID NO: 2539 - protein, 6 aa, Artificial Sequence
  Description of Artificial Sequence: Synthetic peptide
  MOD_RES (3)..(4): Any amino acid
QCXXCH

SEQ ID NO: 2540 - protein, 6 aa, Artificial Sequence
  Description of Artificial Sequence: Synthetic peptide
  MOD_RES (3)..(4): Any amino acid
DGXXGK

SEQ ID NO: 2541 - protein, 6 aa, Artificial Sequence
  Description of Artificial Sequence: Synthetic peptide
  MOD_RES (3)..(4): Any amino acid
ACXXDS

SEQ ID NO: 2542 - protein, 6 aa, Artificial Sequence
  Description of Artificial Sequence: Synthetic peptide
  MOD_RES (3)..(4): Any amino acid
GSXXTT

SEQ ID NO: 2543 - protein, 6 aa, Artificial Sequence
  Description of Artificial Sequence: Synthetic peptide
  MOD_RES (3)..(4): Any amino acid
LGXXCR

SEQ ID NO: 2544 - protein, 6 aa, Artificial Sequence
  Description of Artificial Sequence: Synthetic peptide
  MOD_RES (3)..(4): Any amino acid
GTXXTF

SEQ ID NO: 2545 - protein, 6 aa, Artificial Sequence
  Description of Artificial Sequence: Synthetic peptide
  MOD_RES (3)..(4): Any amino acid
SSXXNT

SEQ ID NO: 2546 - protein, 6 aa, Artificial Sequence
  Description of Artificial Sequence: Synthetic peptide
  MOD_RES (3)..(4): Any amino acid
AAXXTT

SEQ ID NO: 2547 - protein, 6 aa, Artificial Sequence
  Description of Artificial Sequence: Synthetic peptide
  MOD_RES (3)..(4): Any amino acid
NAXXTT

SEQ ID NO: 2548 - protein, 6 aa, Artificial Sequence
  Description of Artificial Sequence: Synthetic peptide
  MOD_RES (3)..(4): Any amino acid
SPXXLS

SEQ ID NO: 2549 - protein, 6 aa, Artificial Sequence
  Description of Artificial Sequence: Synthetic peptide
  MOD_RES (3)..(4): Any amino acid
GVXXSA

SEQ ID NO: 2550 - protein, 6 aa, Artificial Sequence
  Description of Artificial Sequence: Synthetic peptide
  MOD_RES (3)..(4): Any amino acid
FPXXLT

SEQ ID NO: 2551 - protein, 6 aa, Artificial Sequence
  Description of Artificial Sequence: Synthetic peptide
  MOD_RES (3)..(4): Any amino acid
KNXXCK

SEQ ID NO: 2552 - protein, 6 aa, Artificial Sequence
  Description of Artificial Sequence: Synthetic peptide
  MOD_RES (3)..(4): Any amino acid
DSXXGK

SEQ ID NO: 2553 - protein, 6 aa, Artificial Sequence
  Description of Artificial Sequence: Synthetic peptide
  MOD_RES (3)..(4): Any amino acid
PGXXAL

SEQ ID NO: 2554 - protein, 6 aa, Artificial Sequence
  Description of Artificial Sequence: Synthetic peptide
  MOD_RES (3)..(4): Any amino acid
PSXXGK

SEQ ID NO: 2555 - protein, 6 aa, Artificial Sequence
  Description of Artificial Sequence: Synthetic peptide
  MOD_RES (3)..(4): Any amino acid
QGXXKT

SEQ ID NO: 2556 - protein, 6 aa, Artificial Sequence
  Description of Artificial Sequence: Synthetic peptide
  MOD_RES (3)..(4): Any amino acid
AKXXNF

SEQ ID NO: 2557 - protein, 6 aa, Artificial Sequence
  Description of Artificial Sequence: Synthetic peptide
  MOD_RES (3)..(4): Any amino acid
NDXXGG

SEQ ID NO: 2558 - protein, 6 aa, Artificial Sequence
  Description of Artificial Sequence: Synthetic peptide
  MOD_RES (3)..(4): Any amino acid
RIXXYT

SEQ ID NO: 2559 - protein, 6 aa, Artificial Sequence
  Description of Artificial Sequence: Synthetic peptide
  MOD_RES (3)..(4): Any amino acid
DAXXKT

SEQ ID NO: 2560 - protein, 6 aa, Artificial Sequence
  Description of Artificial Sequence: Synthetic peptide
  MOD_RES (3)..(4): Any amino acid
HHXXLP

SEQ ID NO: 2561 - protein, 6 aa, Artificial Sequence
  Description of Artificial Sequence: Synthetic peptide
  MOD_RES (3)..(4): Any amino acid
VSXXCI

SEQ ID NO: 2562 - protein, 6 aa, Artificial Sequence
  Description of Artificial Sequence: Synthetic peptide
  MOD_RES (3)..(4): Any amino acid
PNXXGK

SEQ ID NO: 2563 - protein, 6 aa, Artificial Sequence
  Description of Artificial Sequence: Synthetic peptide
  MOD_RES (3)..(4): Any amino acid
QTXXAK

SEQ ID NO: 2564 - protein, 6 aa, Artificial Sequence
  Description of Artificial Sequence: Synthetic peptide
  MOD_RES (3)..(4): Any amino acid
GQXXMS

SEQ ID NO: 2565 - protein, 6 aa, Artificial Sequence
  Description of Artificial Sequence: Synthetic peptide
  MOD_RES (3)..(4): Any amino acid
EAXXAE

SEQ ID NO: 2566 - protein, 6 aa, Artificial Sequence
  Description of Artificial Sequence: Synthetic peptide
  MOD_RES (3)..(4): Any amino acid
DNXXVP

SEQ ID NO: 2567 - protein, 6 aa, Artificial Sequence
  Description of Artificial Sequence: Synthetic peptide
  MOD_RES (3)..(4): Any amino acid
QCXXCW

SEQ ID NO: 2568 - protein, 6 aa, Artificial Sequence
  Description of Artificial Sequence: Synthetic peptide
  MOD_RES (3)..(4): Any amino acid
MEXXTL

SEQ ID NO: 2569 - protein, 6 aa, Artificial Sequence
  Description of Artificial Sequence: Synthetic peptide
  MOD_RES (3)..(4): Any amino acid
QCXXCW

SEQ ID NO: 2570 - protein, 6 aa, Artificial Sequence
  Description of Artificial Sequence: Synthetic peptide
  MOD_RES (3)..(4): Any amino acid
GLXXWK

SEQ ID NO: 2571 - protein, 6 aa, Artificial Sequence
  Description of Artificial Sequence: Synthetic peptide
  MOD_RES (3)..(4): Any amino acid
TVXXNE

SEQ ID NO: 2572 - protein, 6 aa, Artificial Sequence
  Description of Artificial Sequence: Synthetic peptide
  MOD_RES (3)..(4): Any amino acid
QVXXYG

SEQ ID NO: 2573 - protein, 6 aa, Artificial Sequence
  Description of Artificial Sequence: Synthetic peptide
  MOD_RES (3)..(4): Any amino acid
NQXXNR

SEQ ID NO: 2574 - protein, 6 aa, Artificial Sequence
  Description of Artificial Sequence: Synthetic peptide
  MOD_RES (3)..(4): Any amino acid
WGXXYA

SEQ ID NO: 2575 - protein, 6 aa, Artificial Sequence
  Description of Artificial Sequence: Synthetic peptide
  MOD_RES (3)..(4): Any amino acid
VQXXGS

SEQ ID NO: 2576 - protein, 6 aa, Artificial Sequence
  Description of Artificial Sequence: Synthetic peptide
  MOD_RES (3)..(4): Any amino acid
TWXXGE

SEQ ID NO: 2577 - protein, 6 aa, Artificial Sequence
  Description of Artificial Sequence: Synthetic peptide
  MOD_RES (3)..(4): Any amino acid
PGXXKG

SEQ ID NO: 2578 - protein, 6 aa, Artificial Sequence
  Description of Artificial Sequence: Synthetic peptide
  MOD_RES (3)..(4): Any amino acid
TDXXAW

SEQ ID NO: 2579 - protein, 6 aa, Artificial Sequence
  Description of Artificial Sequence: Synthetic peptide
  MOD_RES (3)..(4): Any amino acid
GAXXTT

SEQ ID NO: 2580 - protein, 6 aa, Artificial Sequence
  Description of Artificial Sequence: Synthetic peptide
  MOD_RES (3)..(4): Any amino acid
GLXXSI

SEQ ID NO: 2581 - protein, 6 aa, Artificial Sequence
  Description of Artificial Sequence: Synthetic peptide
  MOD_RES (3)..(4): Any amino acid
GVXXSN

SEQ ID NO: 2582 - protein, 6 aa, Artificial Sequence
  Description of Artificial Sequence: Synthetic peptide
  MOD_RES (3)..(4): Any amino acid
SNXXNA

SEQ ID NO: 2583 - protein, 6 aa, Artificial Sequence
  Description of Artificial Sequence: Synthetic peptide
  MOD_RES (3)..(4): Any amino acid
GYXXNF

SEQ ID NO: 2584 - protein, 6 aa, Artificial Sequence
  Description of Artificial Sequence: Synthetic peptide
  MOD_RES (3)..(4): Any amino acid
ACXXCH

SEQ ID NO: 2585 - protein, 6 aa, Artificial Sequence
  Description of Artificial Sequence: Synthetic peptide
  MOD_RES (3)..(4): Any amino acid
NAXXSD

SEQ ID NO: 2586 - protein, 6 aa, Artificial Sequence
  Description of Artificial Sequence: Synthetic peptide
  MOD_RES (3)..(4): Any amino acid
GDXXDI

SEQ ID NO: 2587 - protein, 6 aa, Artificial Sequence
  Description of Artificial Sequence: Synthetic peptide
  MOD_RES (3)..(4): Any amino acid
NSXXTT

SEQ ID NO: 2588 - protein, 6 aa, Artificial Sequence
  Description of Artificial Sequence: Synthetic peptide
  MOD_RES (3)..(4): Any amino acid
GCXXCH

SEQ ID NO: 2589 - protein, 6 aa, Artificial Sequence
  Description of Artificial Sequence: Synthetic peptide
  MOD_RES (3)..(4): Any amino acid
LTXXHY

SEQ ID NO: 2590 - protein, 6 aa, Artificial Sequence
  Description of Artificial Sequence: Synthetic peptide
  MOD_RES (3)..(4): Any amino acid
TCXXCH

SEQ ID NO: 2591 - protein, 6 aa, Artificial Sequence
  Description of Artificial Sequence: Synthetic peptide
  MOD_RES (3)..(4): Any amino acid
GVXXSS

SEQ ID NO: 2592 - protein, 6 aa, Artificial Sequence
  Description of Artificial Sequence: Synthetic peptide
  MOD_RES (3)..(4): Any amino acid
MCXXAL

SEQ ID NO: 2593 - protein, 6 aa, Artificial Sequence
  Description of Artificial Sequence: Synthetic peptide
  MOD_RES (3)..(3): Any amino acid
  MOD_RES (5)..(5): Any amino acid
STXVXK

SEQ ID NO: 2594 - protein, 6 aa, Artificial Sequence
  Description of Artificial Sequence: Synthetic peptide
  MOD_RES (3)..(3): Any amino acid
  MOD_RES (5)..(5): Any amino acid
GSXKXT

SEQ ID NO: 2595 - protein, 6 aa, Artificial Sequence
  Description of Artificial Sequence: Synthetic peptide
  MOD_RES (3)..(3): Any amino acid
  MOD_RES (5)..(5): Any amino acid
TKXDXK

SEQ ID NO: 2596 - protein, 6 aa, Artificial Sequence
  Description of Artificial Sequence: Synthetic peptide
  MOD_RES (3)..(3): Any amino acid
  MOD_RES (5)..(5): Any amino acid
TQXGXT

SEQ ID NO: 2597 - protein, 6 aa, Artificial Sequence
  Description of Artificial Sequence: Synthetic peptide
  MOD_RES (3)..(3): Any amino acid
  MOD_RES (5)..(5): Any amino acid
CKXGXT

SEQ ID NO: 2598 - protein, 6 aa, Artificial Sequence
  Description of Artificial Sequence: Synthetic peptide
  MOD_RES (3)..(3): Any amino acid
  MOD_RES (5)..(5): Any amino acid
VAXKXG

SEQ ID NO: 2599 - protein, 6 aa, Artificial Sequence
  Description of Artificial Sequence: Synthetic peptide
  MOD_RES (3)..(3): Any amino acid
  MOD_RES (5)..(5): Any amino acid
CSXGXG

SEQ ID NO: 2600 - protein, 6 aa, Artificial Sequence
  Description of Artificial Sequence: Synthetic peptide
  MOD_RES (3)..(3): Any amino acid
  MOD_RES (5)..(5): Any amino acid
FPXHXA

SEQ ID NO: 2601 - protein, 6 aa, Artificial Sequence
  Description of Artificial Sequence: Synthetic peptide
  MOD_RES (3)..(3): Any amino acid
  MOD_RES (5)..(5): Any amino acid
SSXKXD

SEQ ID NO: 2602 - protein, 6 aa, Artificial Sequence
  Description of Artificial Sequence: Synthetic peptide
  MOD_RES (3)..(3): Any amino acid
  MOD_RES (5)..(5): Any amino acid
PTXNXG

SEQ ID NO: 2603 - protein, 6 aa, Artificial Sequence
  Description of Artificial Sequence: Synthetic peptide
  MOD_RES (3)..(3): Any amino acid
  MOD_RES (5)..(5): Any amino acid
AAXKXT

SEQ ID NO: 2604 - protein, 6 aa, Artificial Sequence
  Description of Artificial Sequence: Synthetic peptide
  MOD_RES (3)..(3): Any amino acid
  MOD_RES (5)..(5): Any amino acid
GAXKXT

SEQ ID NO: 2605 - protein, 6 aa, Artificial Sequence
  Description of Artificial Sequence: Synthetic peptide
  MOD_RES (3)..(3): Any amino acid
  MOD_RES (5)..(5): Any amino acid
YAXGXT

SEQ ID NO: 2606 - protein, 6 aa, Artificial Sequence
  Description of Artificial Sequence: Synthetic peptide
  MOD_RES (3)..(3): Any amino acid
  MOD_RES (5)..(5): Any amino acid
SAXIXR

SEQ ID NO: 2607 - protein, 6 aa, Artificial Sequence
  Description of Artificial Sequence: Synthetic peptide
  MOD_RES (3)..(3): Any amino acid
  MOD_RES (5)..(5): Any amino acid
NTXVXK

SEQ ID NO: 2608 - protein, 6 aa, Artificial Sequence
  Description of Artificial Sequence: Synthetic peptide
  MOD_RES (3)..(3): Any amino acid
  MOD_RES (5)..(5): Any amino acid
GVXKXS

SEQ ID NO: 2609 - protein, 6 aa, Artificial Sequence
  Description of Artificial Sequence: Synthetic peptide
  MOD_RES (3)..(3): Any amino acid
  MOD_RES (5)..(5): Any amino acid
ACXGXS

SEQ ID NO: 2610 - protein, 6 aa, Artificial Sequence
  Description of Artificial Sequence: Synthetic peptide
  MOD_RES (3)..(3): Any amino acid
  MOD_RES (5)..(5): Any amino acid
GVXKXA

SEQ ID NO: 2611 - protein, 6 aa, Artificial Sequence
  Description of Artificial Sequence: Synthetic peptide
  MOD_RES (3)..(3): Any amino acid
  MOD_RES (5)..(5): Any amino acid
LDXAXK

SEQ ID NO: 2612 - protein, 6 aa, Artificial Sequence
  Description of Artificial Sequence: Synthetic peptide
  MOD_RES (3)..(3): Any amino acid
  MOD_RES (5)..(5): Any amino acid
FKXSXF

SEQ ID NO: 2613 - protein, 6 aa, Artificial Sequence
  Description of Artificial Sequence: Synthetic peptide
  MOD_RES (3)..(3): Any amino acid
  MOD_RES (5)..(5): Any amino acid
ADXLXP

SEQ ID NO: 2614 - protein, 6 aa, Artificial Sequence
  Description of Artificial Sequence: Synthetic peptide
  MOD_RES (3)..(3): Any amino acid
  MOD_RES (5)..(5): Any amino acid
ASXNXY

SEQ ID NO: 2615 - protein, 6 aa, Artificial Sequence
  Description of Artificial Sequence: Synthetic peptide
  MOD_RES (3)..(3): Any amino acid
  MOD_RES (5)..(5): Any amino acid
EAXRXT

SEQ ID NO: 2616 - protein, 6 aa, Artificial Sequence
  Description of Artificial Sequence: Synthetic peptide
  MOD_RES (3)..(3): Any amino acid
  MOD_RES (5)..(5): Any amino acid
SAXVXR

SEQ ID NO: 2617 - protein, 6 aa, Artificial Sequence
  Description of Artificial Sequence: Synthetic peptide
  MOD_RES (3)..(3): Any amino acid
  MOD_RES (5)..(5): Any amino acid
VSXGXG

SEQ ID NO: 2618 - protein, 6 aa, Artificial Sequence
  Description of Artificial Sequence: Synthetic peptide
  MOD_RES (3)..(3): Any amino acid
  MOD_RES (5)..(5): Any amino acid
GTXKXF

SEQ ID NO: 2619 - protein, 6 aa, Artificial Sequence
  Description of Artificial Sequence: Synthetic peptide
  MOD_RES (3)..(3): Any amino acid
  MOD_RES (5)..(5): Any amino acid
TGXGXT

SEQ ID NO: 2620 - protein, 6 aa, Artificial Sequence
  Description of Artificial Sequence: Synthetic peptide
  MOD_RES (3)..(3): Any amino acid
  MOD_RES (5)..(5): Any amino acid
QTXTXK

SEQ ID NO: 2621 - protein, 6 aa, Artificial Sequence
  Description of Artificial Sequence: Synthetic peptide
  MOD_RES (3)..(3): Any amino acid
  MOD_RES (5)..(5): Any amino acid
MEXCXL

SEQ ID NO: 2622 - protein, 6 aa, Artificial Sequence
  Description of Artificial Sequence: Synthetic peptide
  MOD_RES (3)..(3): Any amino acid
  MOD_RES (5)..(5): Any amino acid
DNXGXT

SEQ ID NO: 2623 - protein, 6 aa, Artificial Sequence
  Description of Artificial Sequence: Synthetic peptide
  MOD_RES (3)..(3): Any amino acid
  MOD_RES (5)..(5): Any amino acid
RMXTXK

SEQ ID NO: 2624 - protein, 6 aa, Artificial Sequence
  Description of Artificial Sequence: Synthetic peptide
  MOD_RES (3)..(3): Any amino acid
  MOD_RES (5)..(5): Any amino acid
CLXNXC

SEQ ID NO: 2625 - protein, 6 aa, Artificial Sequence
  Description of Artificial Sequence: Synthetic peptide
  MOD_RES (3)..(3): Any amino acid
  MOD_RES (5)..(5): Any amino acid
GLXFXI

SEQ ID NO: 2626 - protein, 6 aa, Artificial Sequence
  Description of Artificial Sequence: Synthetic peptide
  MOD_RES (3)..(3): Any amino acid
  MOD_RES (5)..(5): Any amino acid
NWXRXV

SEQ ID NO: 2627 - protein, 6 aa, Artificial Sequence
  Description of Artificial Sequence: Synthetic peptide
  MOD_RES (3)..(3): Any amino acid
  MOD_RES (5)..(5): Any amino acid
SAXIXR

SEQ ID NO: 2628 - protein, 6 aa, Artificial Sequence
  Description of Artificial Sequence: Synthetic peptide
  MOD_RES (3)..(3): Any amino acid
  MOD_RES (5)..(5): Any amino acid
LDXAXK

SEQ ID NO: 2629 - protein, 6 aa, Artificial Sequence
  Description of Artificial Sequence: Synthetic peptide
  MOD_RES (3)..(3): Any amino acid
  MOD_RES (5)..(5): Any amino acid
NAXKXT

SEQ ID NO: 2630 - protein, 6 aa, Artificial Sequence
  Description of Artificial Sequence: Synthetic peptide
  MOD_RES (3)..(3): Any amino acid
  MOD_RES (5)..(5): Any amino acid
SGXGXS

SEQ ID NO: 2631 - protein, 6 aa, Artificial Sequence
  Description of Artificial Sequence: Synthetic peptide
  MOD_RES (3)..(3): Any amino acid
  MOD_RES (5)..(5): Any amino acid
TPXLXK

SEQ ID NO: 2632 - protein, 6 aa, Artificial Sequence
  Description of Artificial Sequence: Synthetic peptide
  MOD_RES (3)..(3): Any amino acid
  MOD_RES (5)..(5): Any amino acid
DGXTXK

SEQ ID NO: 2633 - protein, 6 aa, Artificial Sequence
  Description of Artificial Sequence: Synthetic peptide
  MOD_RES (3)..(3): Any amino acid
  MOD_RES (5)..(5): Any amino acid
NVXCXN

SEQ ID NO: 2634 - protein, 6 aa, Artificial Sequence
  Description of Artificial Sequence: Synthetic peptide
  MOD_RES (3)..(3): Any amino acid
  MOD_RES (5)..(5): Any amino acid
SSXGXT

SEQ ID NO: 2635 - protein, 6 aa, Artificial Sequence
  Description of Artificial Sequence: Synthetic peptide
  MOD_RES (3)..(3): Any amino acid
  MOD_RES (5)..(5): Any amino acid
TQXPXS

SEQ ID NO: 2636 - protein, 6 aa, Artificial Sequence
  Description of Artificial Sequence: Synthetic peptide
  MOD_RES (3)..(3): Any amino acid
  MOD_RES (5)..(5): Any amino acid
GVXKXN

SEQ ID NO: 2637 - protein, 6 aa, Artificial Sequence
  Description of Artificial Sequence: Synthetic peptide
  MOD_RES (3)..(3): Any amino acid
  MOD_RES (5)..(5): Any amino acid
GGXWXF

SEQ ID NO: 2638 - protein, 6 aa, Artificial Sequence
  Description of Artificial Sequence: Synthetic peptide
  MOD_RES (3)..(3): Any amino acid
  MOD_RES (5)..(5): Any amino acid
NVXKXS

SEQ ID NO: 2639 - protein, 6 aa, Artificial Sequence
  Description of Artificial Sequence: Synthetic peptide
  MOD_RES (3)..(3): Any amino acid
  MOD_RES (5)..(5): Any amino acid
DAXGXT

SEQ ID NO: 2640 - protein, 6 aa, Artificial Sequence
  Description of Artificial Sequence: Synthetic peptide
  MOD_RES (3)..(3): Any amino acid
  MOD_RES (5)..(5): Any amino acid
NSXKXT

SEQ ID NO: 2641 - protein, 6 aa, Artificial Sequence
  Description of Artificial Sequence: Synthetic peptide
  MOD_RES (3)..(3): Any amino acid
  MOD_RES (5)..(5): Any amino acid
IVXYXP

SEQ ID NO: 2642 - protein, 6 aa, Artificial Sequence
  Description of Artificial Sequence: Synthetic peptide
  MOD_RES (3)..(3): Any amino acid
  MOD_RES (5)..(5): Any amino acid
RIXNXT

SEQ ID NO: 2643 - protein, 6 aa, Artificial Sequence
  Description of Artificial Sequence: Synthetic peptide
  MOD_RES (3)..(3): Any amino acid
  MOD_RES (5)..(5): Any amino acid
KCXAXH

SEQ ID NO: 2644 - protein, 6 aa, Artificial Sequence
  Description of Artificial Sequence: Synthetic peptide
  MOD_RES (3)..(3): Any amino acid
  MOD_RES (5)..(5): Any amino acid
RLXPXE

SEQ ID NO: 2645 - protein, 6 aa, Artificial Sequence
  Description of Artificial Sequence: Synthetic peptide
  MOD_RES (3)..(3): Any amino acid
  MOD_RES (5)..(5): Any amino acid
GQXIXS

SEQ ID NO: 2646 - protein, 6 aa, Artificial Sequence
  Description of Artificial Sequence: Synthetic peptide
  MOD_RES (3)..(3): Any amino acid
  MOD_RES (5)..(5): Any amino acid
GDXHXI

SEQ ID NO: 2647 - protein, 6 aa, Artificial Sequence
  Description of Artificial Sequence: Synthetic peptide
  MOD_RES (3)..(3): Any amino acid
  MOD_RES (5)..(5): Any amino acid
SWXRXC

SEQ ID NO: 2648 - protein, 6 aa, Artificial Sequence
  Description of Artificial Sequence: Synthetic peptide
  MOD_RES (3)..(3): Any amino acid
  MOD_RES (5)..(5): Any amino acid
DSXVXK

SEQ ID NO: 2649 - protein, 6 aa, Artificial Sequence
  Description of Artificial Sequence: Synthetic peptide
  MOD_RES (3)..(3): Any amino acid
  MOD_RES (5)..(5): Any amino acid
FTXAXN

SEQ ID NO: 2650 - protein, 6 aa, Artificial Sequence
  Description of Artificial Sequence: Synthetic peptide
  MOD_RES (3)..(3): Any amino acid
  MOD_RES (5)..(5): Any amino acid
HHXEXP

SEQ ID NO: 2651 - protein, 6 aa, Artificial Sequence
  Description of Artificial Sequence: Synthetic peptide
  MOD_RES (3)..(3): Any amino acid
  MOD_RES (5)..(5): Any amino acid
NQXPXR

SEQ ID NO: 2652 - protein, 6 aa, Artificial Sequence
  Description of Artificial Sequence: Synthetic peptide
  MOD_RES (3)..(3): Any amino acid
  MOD_RES (5)..(5): Any amino acid
RGXGXG

SEQ ID NO: 2653 - protein, 6 aa, Artificial Sequence
  Description of Artificial Sequence: Synthetic peptide
  MOD_RES (3)..(3): Any amino acid
  MOD_RES (5)..(5): Any amino acid
PNXSXK

SEQ ID NO: 2654 - protein, 6 aa, Artificial Sequence
  Description of Artificial Sequence: Synthetic peptide
  MOD_RES (3)..(3): Any amino acid
  MOD_RES (5)..(5): Any amino acid
EEXGXW

SEQ ID NO: 2655 - protein, 6 aa, Artificial Sequence
  Description of Artificial Sequence: Synthetic peptide
  MOD_RES (3)..(3): Any amino acid
  MOD_RES (5)..(5): Any amino acid
SPXSXS

SEQ ID NO: 2656 - protein, 6 aa, Artificial Sequence
  Description of Artificial Sequence: Synthetic peptide
  MOD_RES (3)..(3): Any amino acid
  MOD_RES (5)..(5): Any amino acid
EFXFXD

SEQ ID NO: 2657 - protein, 6 aa, Artificial Sequence
  Description of Artificial Sequence: Synthetic peptide
  MOD_RES (3)..(3): Any amino acid
  MOD_RES (5)..(5): Any amino acid
QGXGXG

SEQ ID NO: 2658 - protein, 6 aa, Artificial Sequence
  Description of Artificial Sequence: Synthetic peptide
  MOD_RES (3)..(3): Any amino acid
  MOD_RES (5)..(5): Any amino acid
GTXKXT

SEQ ID NO: 2659 - protein, 6 aa, Artificial Sequence
  Description of Artificial Sequence: Synthetic peptide
  MOD_RES (3)..(3): Any amino acid
  MOD_RES (5)..(5): Any amino acid
LGXIXR

SEQ ID NO: 2660 - protein, 6 aa, Artificial Sequence
  Description of Artificial Sequence: Synthetic peptide
  MOD_RES (3)..(3): Any amino acid
  MOD_RES (5)..(5): Any amino acid
SDXAXN

SEQ ID NO: 2661 - protein, 6 aa, Artificial Sequence
  Description of Artificial Sequence: Synthetic peptide
  MOD_RES (3)..(3): Any amino acid
  MOD_RES (5)..(5): Any amino acid
KNXFXV

SEQ ID NO: 2662 - protein, 6 aa, Artificial Sequence
  Description of Artificial Sequence: Synthetic peptide
  MOD_RES (3)..(3): Any amino acid
  MOD_RES (5)..(5): Any amino acid
CSXGXG

SEQ ID NO: 2663 - protein, 6 aa, Artificial Sequence
  Description of Artificial Sequence: Synthetic peptide
  MOD_RES (3)..(3): Any amino acid
  MOD_RES (5)..(5): Any amino acid
LGXSXV

SEQ ID NO: 2664 - protein, 6 aa, Artificial Sequence
  Description of Artificial Sequence: Synthetic peptide
  MOD_RES (3)..(3): Any amino acid
  MOD_RES (5)..(5): Any amino acid
NYXPXL

SEQ ID NO: 2665 - protein, 6 aa, Artificial Sequence
  Description of Artificial Sequence: Synthetic peptide
  MOD_RES (3)..(3): Any amino acid
  MOD_RES (5)..(5): Any amino acid
SCXQXT

SEQ ID NO: 2666 - protein, 6 aa, Artificial Sequence
  Description of Artificial Sequence: Synthetic peptide
  MOD_RES (3)..(3): Any amino acid
  MOD_RES (5)..(5): Any amino acid
NRXKXT

SEQ ID NO: 2667 - protein, 6 aa, Artificial Sequence
  Description of Artificial Sequence: Synthetic peptide
  MOD_RES (3)..(3): Any amino acid
  MOD_RES (5)..(5): Any amino acid
GFXIXG

SEQ ID NO: 2668 - protein, 6 aa, Artificial Sequence
  Description of Artificial Sequence: Synthetic peptide
  MOD_RES (3)..(3): Any amino acid
  MOD_RES (5)..(5): Any amino acid
QVXGXG

SEQ ID NO: 2669 - protein, 6 aa, Artificial Sequence
  Description of Artificial Sequence: Synthetic peptide
  MOD_RES (3)..(3): Any amino acid
  MOD_RES (5)..(5): Any amino acid
QRXGXG

SEQ ID NO: 2670 - protein, 6 aa, Artificial Sequence
  Description of Artificial Sequence: Synthetic peptide
  MOD_RES (3)..(3): Any amino acid
  MOD_RES (5)..(5): Any amino acid
KNXAXK

SEQ ID NO: 2671 - protein, 6 aa, Artificial Sequence
  Description of Artificial Sequence: Synthetic peptide
  MOD_RES (3)..(3): Any amino acid
  MOD_RES (5)..(5): Any amino acid
QAXCXQ

SEQ ID NO: 2672 - protein, 6 aa, Artificial Sequence
  Description of Artificial Sequence: Synthetic peptide
  MOD_RES (3)..(3): Any amino acid
  MOD_RES (5)..(5): Any amino acid
STXEXT

SEQ ID NO: 2673 - protein, 6 aa, Artificial Sequence
  Description of Artificial Sequence: Synthetic peptide
  MOD_RES (3)..(3): Any amino acid
  MOD_RES (5)..(5): Any amino acid
KDXRXE

SEQ ID NO: 2674 - protein, 6 aa, Artificial Sequence
  Description of Artificial Sequence: Synthetic peptide
  MOD_RES (3)..(3): Any amino acid
  MOD_RES (5)..(5): Any amino acid
GHXYXT

SEQ ID NO: 2675 - protein, 6 aa, Artificial Sequence
  Description of Artificial Sequence: Synthetic peptide
  MOD_RES (3)..(3): Any amino acid
  MOD_RES (5)..(5): Any amino acid
YRXLXV

SEQ ID NO: 2676 - protein, 6 aa, Artificial Sequence
  Description of Artificial Sequence: Synthetic peptide
  MOD_RES (3)..(3): Any amino acid
  MOD_RES (5)..(5): Any amino acid
PGXGXG

SEQ ID NO: 2677 - protein, 6 aa, Artificial Sequence
  Description of Artificial Sequence: Synthetic peptide
  MOD_RES (3)..(3): Any amino acid
  MOD_RES (5)..(5): Any amino acid
REXGXS

SEQ ID NO: 2678 - protein, 6 aa, Artificial Sequence
  Description of Artificial Sequence: Synthetic peptide
  MOD_RES (3)..(3): Any amino acid
  MOD_RES (5)..(5): Any amino acid
GTXKXC

SEQ ID NO: 2679 - protein, 6 aa, Artificial Sequence
  Description of Artificial Sequence: Synthetic peptide
  MOD_RES (3)..(3): Any amino acid
  MOD_RES (5)..(5): Any amino acid
QCXSXW

SEQ ID NO: 2680 - protein, 6 aa, Artificial Sequence
  Description of Artificial Sequence: Synthetic peptide
  MOD_RES (3)..(3): Any amino acid
  MOD_RES (5)..(5): Any amino acid
TAXLXL

SEQ ID NO: 2681 - protein, 6 aa, Artificial Sequence
  Description of Artificial Sequence: Synthetic peptide
  MOD_RES (3)..(3): Any amino acid
  MOD_RES (5)..(5): Any amino acid
SGXGXT

SEQ ID NO: 2682 - protein, 6 aa, Artificial Sequence
  Description of Artificial Sequence: Synthetic peptide
  MOD_RES (3)..(3): Any amino acid
  MOD_RES (5)..(5): Any amino acid
KQXTXN

SEQ ID NO: 2683 - protein, 6 aa, Artificial Sequence
  Description of Artificial Sequence: Synthetic peptide
  MOD_RES (3)..(3): Any amino acid
  MOD_RES (5)..(5): Any amino acid
DKXGXP

SEQ ID NO: 2684 - protein, 6 aa, Artificial Sequence
  Description of Artificial Sequence: Synthetic peptide
  MOD_RES (3)..(3): Any amino acid
  MOD_RES (5)..(5): Any amino acid
EYXPXG

SEQ ID NO: 2685 - protein, 6 aa, Artificial Sequence
  Description of Artificial Sequence: Synthetic peptide
  MOD_RES (3)..(3): Any amino acid
  MOD_RES (5)..(5): Any amino acid
SPXLXD

SEQ ID NO: 2686 - protein, 6 aa, Artificial Sequence
  Description of Artificial Sequence: Synthetic peptide
  MOD_RES (3)..(3): Any amino acid
  MOD_RES (5)..(5): Any amino acid
QSXSXL

SEQ ID NO: 2687 - protein, 6 aa, Artificial Sequence
  Description of Artificial Sequence: Synthetic peptide
  MOD_RES (3)..(3): Any amino acid
  MOD_RES (5)..(5): Any amino acid
KMXFXL

SEQ ID NO: 2688 - protein, 6 aa, Artificial Sequence
  Description of Artificial Sequence: Synthetic peptide
  MOD_RES (3)..(3): Any amino acid
  MOD_RES (5)..(5): Any amino acid
ELXPXR

SEQ ID NO: 2689 - protein, 6 aa, Artificial Sequence
  Description of Artificial Sequence: Synthetic peptide
  MOD_RES (3)..(3): Any amino acid
  MOD_RES (5)..(5): Any amino acid
GQXGXC

SEQ ID NO: 2690 - protein, 6 aa, Artificial Sequence
  Description of Artificial Sequence: Synthetic peptide
  MOD_RES (3)..(3): Any amino acid
  MOD_RES (5)..(5): Any amino acid
TKXFXN

SEQ ID NO: 2691 - protein, 6 aa, Artificial Sequence
  Description of Artificial Sequence: Synthetic peptide
  MOD_RES (3)..(3): Any amino acid
  MOD_RES (5)..(5): Any amino acid
QGXGXT

SEQ ID NO: 2692 - protein, 6 aa, Artificial Sequence
  Description of Artificial Sequence: Synthetic peptide
  MOD_RES (3)..(3): Any amino acid
STXVDK

SEQ ID NO: 2693 - protein, 6 aa, Artificial Sequence
  Description of Artificial Sequence: Synthetic peptide
  MOD_RES (3)..(3): Any amino acid
TKXDKK

SEQ ID NO: 2694 - protein, 6 aa, Artificial Sequence
  Description of Artificial Sequence: Synthetic peptide
  MOD_RES (3)..(3): Any amino acid
SSXKVD

SEQ ID NO: 2695 - protein, 6 aa, Artificial Sequence
  Description of Artificial Sequence: Synthetic peptide
  MOD_RES (3)..(3): Any amino acid
TQXGKT

SEQ ID NO: 2696 - protein, 6 aa, Artificial Sequence
  Description of Artificial Sequence: Synthetic peptide
  MOD_RES (3)..(3): Any amino acid
GSXKST

SEQ ID NO: 2697 - protein, 6 aa, Artificial Sequence
  Description of Artificial Sequence: Synthetic peptide
  MOD_RES (3)..(3): Any amino acid
SAXIGR

SEQ ID NO: 2698 - protein, 6 aa, Artificial Sequence
  Description of Artificial Sequence: Synthetic peptide
  MOD_RES (3)..(3): Any amino acid
NTXVDK

SEQ ID NO: 2699 - protein, 6 aa, Artificial Sequence
  Description of Artificial Sequence: Synthetic peptide
  MOD_RES (3)..(3): Any amino acid
YAXGRT

SEQ ID NO: 2700 - protein, 6 aa, Artificial Sequence
  Description of Artificial Sequence: Synthetic peptide
  MOD_RES (3)..(3): Any amino acid
CSXGIG

SEQ ID NO: 2701 - protein, 6 aa, Artificial Sequence
  Description of Artificial Sequence: Synthetic peptide
  MOD_RES (3)..(3): Any amino acid
LDXAGK

SEQ ID NO: 2702 - protein, 6 aa, Artificial Sequence
  Description of Artificial Sequence: Synthetic peptide
  MOD_RES (3)..(3): Any amino acid
TGXGKT

SEQ ID NO: 2703 - protein, 6 aa, Artificial Sequence
  Description of Artificial Sequence: Synthetic peptide
  MOD_RES (3)..(3): Any amino acid
SAXVGR

SEQ ID NO: 2704 - protein, 6 aa, Artificial Sequence
  Description of Artificial Sequence: Synthetic peptide
  MOD_RES (3)..(3): Any amino acid
SGXGKS

SEQ ID NO: 2705 - protein, 6 aa, Artificial Sequence
  Description of Artificial Sequence: Synthetic peptide
  MOD_RES (3)..(3): Any amino acid
PTXNIG

SEQ ID NO: 2706 - protein, 6 aa, Artificial Sequence
  Description of Artificial Sequence: Synthetic peptide
  MOD_RES (3)..(3): Any amino acid
SAXIGR

SEQ ID NO: 2707 - protein, 6 aa, Artificial Sequence
  Description of Artificial Sequence: Synthetic peptide
  MOD_RES (3)..(3): Any amino acid
GTXVVG

SEQ ID NO: 2708 - protein, 6 aa, Artificial Sequence
  Description of Artificial Sequence: Synthetic peptide
  MOD_RES (3)..(3): Any amino acid
VAXKNG

SEQ ID NO: 2709 - protein, 6 aa, Artificial Sequence
  Description of Artificial Sequence: Synthetic peptide
  MOD_RES (3)..(3): Any amino acid
GVXKSA

SEQ ID NO: 2710 - protein, 6 aa, Artificial Sequence
  Description of Artificial Sequence: Synthetic peptide
  MOD_RES (3)..(3): Any amino acid
ACXGDS

SEQ ID NO: 2711 - protein, 6 aa, Artificial Sequence
  Description of Artificial Sequence: Synthetic peptide
  MOD_RES (3)..(3): Any amino acid
DNXGKT

SEQ ID NO: 2712 - protein, 6 aa, Artificial Sequence
  Description of Artificial Sequence: Synthetic peptide
  MOD_RES (3)..(3): Any amino acid
RSXFLE

SEQ ID NO: 2713 - protein, 6 aa, Artificial Sequence
  Description of Artificial Sequence: Synthetic peptide
  MOD_RES (3)..(3): Any amino acid
GTXKPV

SEQ ID NO: 2714 - protein, 6 aa, Artificial Sequence
  Description of Artificial Sequence: Synthetic peptide
  MOD_RES (3)..(3): Any amino acid
ASXNTY

SEQ ID NO: 2715 - protein, 6 aa, Artificial Sequence
  Description of Artificial Sequence: Synthetic peptide
  MOD_RES (3)..(3): Any amino acid
YIXIHA

SEQ ID NO: 2716 - protein, 6 aa, Artificial Sequence
  Description of Artificial Sequence: Synthetic peptide
  MOD_RES (3)..(3): Any amino acid
DDXRFV

SEQ ID NO: 2717 - protein, 6 aa, Artificial Sequence
  Description of Artificial Sequence: Synthetic peptide
  MOD_RES (3)..(3): Any amino acid
GYXDNG

SEQ ID NO: 2718 - protein, 6 aa, Artificial Sequence
  Description of Artificial Sequence: Synthetic peptide
  MOD_RES (3)..(3): Any amino acid
DGXTGK

SEQ ID NO: 2719 - protein, 6 aa, Artificial Sequence
  Description of Artificial Sequence: Synthetic peptide
  MOD_RES (3)..(3): Any amino acid
GSXKTT

SEQ ID NO: 2720 - protein, 6 aa, Artificial Sequence
  Description of Artificial Sequence: Synthetic peptide
  MOD_RES (3)..(3): Any amino acid
NAXKTT

SEQ ID NO: 2721 - protein, 6 aa, Artificial Sequence
  Description of Artificial Sequence: Synthetic peptide
  MOD_RES (3)..(3): Any amino acid
CSXGVG

SEQ ID NO: 2722 - protein, 6 aa, Artificial Sequence
  Description of Artificial Sequence: Synthetic peptide
  MOD_RES (3)..(3): Any amino acid
CLXNIC

SEQ ID NO: 2723 - protein, 6 aa, Artificial Sequence
  Description of Artificial Sequence: Synthetic peptide
  MOD_RES (3)..(3): Any amino acid
DAXGKT

SEQ ID NO: 2724 - protein, 6 aa, Artificial Sequence
  Description of Artificial Sequence: Synthetic peptide
  MOD_RES (3)..(3): Any amino acid
GTXKTF

SEQ ID NO: 2725 - protein, 6 aa, Artificial Sequence
  Description of Artificial Sequence: Synthetic peptide
  MOD_RES (3)..(3): Any amino acid
AAXKTT

SEQ ID NO: 2726 - protein, 6 aa, Artificial Sequence
  Description of Artificial Sequence: Synthetic peptide
  MOD_RES (3)..(3): Any amino acid
RMXTFK

SEQ ID NO: 2727 - protein, 6 aa, Artificial Sequence
  Description of Artificial Sequence: Synthetic peptide
  MOD_RES (3)..(3): Any amino acid
LDXAGK

SEQ ID NO: 2728 - protein, 6 aa, Artificial Sequence
  Description of Artificial Sequence: Synthetic peptide
  MOD_RES (3)..(3): Any amino acid
GAXKTT

SEQ ID NO: 2729 - protein, 6 aa, Artificial Sequence
  Description of Artificial Sequence: Synthetic peptide
  MOD_RES (3)..(3): Any amino acid
IVXYTP

SEQ ID NO: 2730 - protein, 6 aa, Artificial Sequence
  Description of Artificial Sequence: Synthetic peptide
  MOD_RES (3)..(3): Any amino acid
CSXGIG

SEQ ID NO: 2731 - protein, 6 aa, Artificial Sequence
  Description of Artificial Sequence: Synthetic peptide
  MOD_RES (3)..(3): Any amino acid
QTXTGK

SEQ ID NO: 2732 - protein, 6 aa, Artificial Sequence
  Description of Artificial Sequence: Synthetic peptide
  MOD_RES (3)..(3): Any amino acid
MEXCTL

SEQ ID NO: 2733 - protein, 6 aa, Artificial Sequence
  Description of Artificial Sequence: Synthetic peptide
  MOD_RES (3)..(3): Any amino acid
GVXKSS

SEQ ID NO: 2734 - protein, 6 aa, Artificial Sequence
  Description of Artificial Sequence: Synthetic peptide
  MOD_RES (3)..(3): Any amino acid
GQXIMS

SEQ ID NO: 2735 - protein, 6 aa, Artificial Sequence
  Description of Artificial Sequence: Synthetic peptide
  MOD_RES (3)..(3): Any amino acid
PNXSGK

SEQ ID NO: 2736 - protein, 6 aa, Artificial Sequence
  Description of Artificial Sequence: Synthetic peptide
  MOD_RES (3)..(3): Any amino acid
SSXGNT

SEQ ID NO: 2737 - protein, 6 aa, Artificial Sequence
  Description of Artificial Sequence: Synthetic peptide
  MOD_RES (3)..(3): Any amino acid
DSXVGK

SEQ ID NO: 2738 - protein, 6 aa, Artificial Sequence
  Description of Artificial Sequence: Synthetic peptide
  MOD_RES (3)..(3): Any amino acid
LGXSIV

SEQ ID NO: 2739 - protein, 6 aa, Artificial Sequence
  Description of Artificial Sequence: Synthetic peptide
  MOD_RES (3)..(3): Any amino acid
LGXICR

SEQ ID NO: 2740 - protein, 6 aa, Artificial Sequence
  Description of Artificial Sequence: Synthetic peptide
  MOD_RES (3)..(3): Any amino acid
NVXCKN

SEQ ID NO: 2741 - protein, 6 aa, Artificial Sequence
  Description of Artificial Sequence: Synthetic peptide
  MOD_RES (3)..(3): Any amino acid
GVXKSN

SEQ ID NO: 2742 - protein, 6 aa, Artificial Sequence
  Description of Artificial Sequence: Synthetic peptide
  MOD_RES (3)..(3): Any amino acid
KNXACK

SEQ ID NO: 2743 - protein, 6 aa, Artificial Sequence
  Description of Artificial Sequence: Synthetic peptide
  MOD_RES (3)..(3): Any amino acid
RIXNYT

SEQ ID NO: 2744 - protein, 6 aa, Artificial Sequence
  Description of Artificial Sequence: Synthetic peptide
  MOD_RES (3)..(3): Any amino acid
QCXSCW

SEQ ID NO: 2745 - protein, 6 aa, Artificial Sequence
  Description of Artificial Sequence: Synthetic peptide
  MOD_RES (3)..(3): Any amino acid
KCXACH

SEQ ID NO: 2746 - protein, 6 aa, Artificial Sequence
  Description of Artificial Sequence: Synthetic peptide
  MOD_RES (3)..(3): Any amino acid
PGXGKG

SEQ ID NO: 2747 - protein, 6 aa, Artificial Sequence
  Description of Artificial Sequence: Synthetic peptide
  MOD_RES (3)..(3): Any amino acid
VDXGKT

SEQ ID NO: 2748 - protein, 6 aa, Artificial Sequence
  Description of Artificial Sequence: Synthetic peptide
  MOD_RES (3)..(3): Any amino acid
GDXHDI

SEQ ID NO: 2749 - protein, 6 aa, Artificial Sequence
  Description of Artificial Sequence: Synthetic peptide
  MOD_RES (3)..(3): Any amino acid
NSXKTT

SEQ ID NO: 2750 - protein, 6 aa, Artificial Sequence
  Description of Artificial Sequence: Synthetic peptide
  MOD_RES (3)..(3): Any amino acid
PSXSGK

SEQ ID NO: 2751 - protein, 6 aa, Artificial Sequence
  Description of Artificial Sequence: Synthetic peptide
  MOD_RES (3)..(3): Any amino acid
NQXPNR

SEQ ID NO: 2752 - protein, 6 aa, Artificial Sequence
  Description of Artificial Sequence: Synthetic peptide
  MOD_RES (3)..(3): Any amino acid
QGXGKT

SEQ ID NO: 2753 - protein, 6 aa, Artificial Sequence
  Description of Artificial Sequence: Synthetic peptide
  MOD_RES (3)..(3): Any amino acid
GGXGKT

SEQ ID NO: 2754 - protein, 6 aa, Artificial Sequence
  Description of Artificial Sequence: Synthetic peptide
  MOD_RES (3)..(3): Any amino acid
EQXVGK

SEQ ID NO: 2755 - protein, 6 aa, Artificial Sequence
  Description of Artificial Sequence: Synthetic peptide
  MOD_RES (3)..(3): Any amino acid
SWXRGC

SEQ ID NO: 2756 - protein, 6 aa, Artificial Sequence
  Description of Artificial Sequence: Synthetic peptide
  MOD_RES (3)..(3): Any amino acid
LSXAGK

SEQ ID NO: 2757 - protein, 6 aa, Artificial Sequence
  Description of Artificial Sequence: Synthetic peptide
  MOD_RES (3)..(3): Any amino acid
QVXGYG

SEQ ID NO: 2758 - protein, 6 aa, Artificial Sequence
  Description of Artificial Sequence: Synthetic peptide
  MOD_RES (3)..(3): Any amino acid
VSXGCI

SEQ ID NO: 2759 - protein, 6 aa, Artificial Sequence
  Description of Artificial Sequence: Synthetic peptide
  MOD_RES (3)..(3): Any amino acid
HHXELP

SEQ ID NO: 2760 - protein, 6 aa, Artificial Sequence
  Description of Artificial Sequence: Synthetic peptide
  MOD_RES (3)..(3): Any amino acid
TPXLPK

SEQ ID NO: 2761 - protein, 6 aa, Artificial Sequence
  Description of Artificial Sequence: Synthetic peptide
  MOD_RES (3)..(3): Any amino acid
ALXVPD

SEQ ID NO: 2762 - protein, 6 aa, Artificial Sequence
  Description of Artificial Sequence: Synthetic peptide
  MOD_RES (3)..(3): Any amino acid
QAXSGL

SEQ ID NO: 2763 - protein, 6 aa, Artificial Sequence
  Description of Artificial Sequence: Synthetic peptide
  MOD_RES (3)..(3): Any amino acid
HKXQSP

SEQ ID NO: 2764 - protein, 6 aa, Artificial Sequence
  Description of Artificial Sequence: Synthetic peptide
  MOD_RES (3)..(3): Any amino acid
LNXGMV

SEQ ID NO: 2765 - protein, 6 aa, Artificial Sequence
  Description of Artificial Sequence: Synthetic peptide
  MOD_RES (3)..(3): Any amino acid
KNXFTV

SEQ ID NO: 2766 - protein, 6 aa, Artificial Sequence
  Description of Artificial Sequence: Synthetic peptide
  MOD_RES (3)..(3): Any amino acid
RGXGIG

SEQ ID NO: 2767 - protein, 6 aa, Artificial Sequence
  Description of Artificial Sequence: Synthetic peptide
  MOD_RES (3)..(3): Any amino acid
PNXGKT

SEQ ID NO: 2768 - protein, 6 aa, Artificial Sequence
  Description of Artificial Sequence: Synthetic peptide
  MOD_RES (3)..(3): Any amino acid
QGXGIM

SEQ ID NO: 2769 - protein, 6 aa, Artificial Sequence
  Description of Artificial Sequence: Synthetic peptide
  MOD_RES (3)..(3): Any amino acid
WGXGYA

SEQ ID NO: 2770 - protein, 6 aa, Artificial Sequence
  Description of Artificial Sequence: Synthetic peptide
  MOD_RES (3)..(3): Any amino acid
TGXGKS

SEQ ID NO: 2771 - protein, 6 aa, Artificial Sequence
  Description of Artificial Sequence: Synthetic peptide
  MOD_RES (3)..(3): Any amino acid
GSXVEK

SEQ ID NO: 2772 - protein, 6 aa, Artificial Sequence
  Description of Artificial Sequence: Synthetic peptide
  MOD_RES (3)..(3): Any amino acid
EFXFPD

SEQ ID NO: 2773 - protein, 6 aa, Artificial Sequence
  Description of Artificial Sequence: Synthetic peptide
  MOD_RES (3)..(3): Any amino acid
VSXGRG

SEQ ID NO: 2774 - protein, 6 aa, Artificial Sequence
  Description of Artificial Sequence: Synthetic peptide
  MOD_RES (3)..(3): Any amino acid
VEXTFP

SEQ ID NO: 2775 - protein, 6 aa, Artificial Sequence
  Description of Artificial Sequence: Synthetic peptide
  MOD_RES (3)..(3): Any amino acid
GTXKSC

SEQ ID NO: 2776 - protein, 6 aa, Artificial Sequence
  Description of Artificial Sequence: Synthetic peptide
  MOD_RES (3)..(3): Any amino acid
SDXAGN

SEQ ID NO: 2777 - protein, 6 aa, Artificial Sequence
  Description of Artificial Sequence: Synthetic peptide
  MOD_RES (3)..(3): Any amino acid
GAXKTS

SEQ ID NO: 2778 - protein, 6 aa, Artificial Sequence
  Description of Artificial Sequence: Synthetic peptide
  MOD_RES (3)..(3): Any amino acid
PNXGKS

SEQ ID NO: 2779 - protein, 6 aa, Artificial Sequence
  Description of Artificial Sequence: Synthetic peptide
  MOD_RES (3)..(3): Any amino acid
GYXDNF

SEQ ID NO: 2780 - protein, 6 aa, Artificial Sequence
  Description of Artificial Sequence: Synthetic peptide
  MOD_RES (3)..(3): Any amino acid
GHXYAT

SEQ ID NO: 2781 - protein, 6 aa, Artificial Sequence
  Description of Artificial Sequence: Synthetic peptide
  MOD_RES (3)..(3): Any amino acid
QAXCSQ

SEQ ID NO: 2782 - protein, 6 aa, Artificial Sequence
  Description of Artificial Sequence: Synthetic peptide
  MOD_RES (3)..(3): Any amino acid
SPXSLS

SEQ ID NO: 2783 - protein, 6 aa, Artificial Sequence
  Description of Artificial Sequence: Synthetic peptide
  MOD_RES (3)..(3): Any amino acid
STXAGK

SEQ ID NO: 2784 - protein, 6 aa, Artificial Sequence
  Description of Artificial Sequence: Synthetic peptide
  MOD_RES (3)..(3): Any amino acid
YRXLVV

SEQ ID NO: 2785 - protein, 6 aa, Artificial Sequence
  Description of Artificial Sequence: Synthetic peptide
  MOD_RES (3)..(3): Any amino acid
GLXDWK

SEQ ID NO: 2786 - protein, 6 aa, Artificial Sequence
  Description of Artificial Sequence: Synthetic peptide
  MOD_RES (3)..(3): Any amino acid
CGXGGW

SEQ ID NO: 2787 - protein, 6 aa, Artificial Sequence
  Description of Artificial Sequence: Synthetic peptide
  MOD_RES (3)..(3): Any amino acid
ELXPLR

SEQ ID NO: 2788 - protein, 6 aa, Artificial Sequence
  Description of Artificial Sequence: Synthetic peptide
  MOD_RES (3)..(3): Any amino acid
GVXKTS

SEQ ID NO: 2789 - protein, 6 aa, Artificial Sequence
  Description of Artificial Sequence: Synthetic peptide
  MOD_RES (3)..(3): Any amino acid
NGXGKS

SEQ ID NO: 2790 - protein, 6 aa, Artificial Sequence
  Description of Artificial Sequence: Synthetic peptide
  MOD_RES (3)..(3): Any amino acid
IYXDRL

SEQ ID NO: 2791 - protein, 6 aa, Artificial Sequence
  Description of Artificial Sequence: Synthetic peptide
  MOD_RES (4)..(5): Any amino acid
STKXXK

SEQ ID NO: 2792 - protein, 6 aa, Artificial Sequence
  Description of Artificial Sequence: Synthetic peptide
  MOD_RES (4)..(5): Any amino acid
EVIXXW

SEQ ID NO: 2793 - protein, 6 aa, Artificial Sequence
  Description of Artificial Sequence: Synthetic peptide
  MOD_RES (4)..(5): Any amino acid
VACXXG

SEQ ID NO: 2794 - protein, 6 aa, Artificial Sequence
  Description of Artificial Sequence: Synthetic peptide
  MOD_RES (4)..(5): Any amino acid
GSGXXT

SEQ ID NO: 2795 - protein, 6 aa, Artificial Sequence
  Description of Artificial Sequence: Synthetic peptide
  MOD_RES (4)..(5): Any amino acid
TQTXXT

SEQ ID NO: 2796 - protein, 6 aa, Artificial Sequence
  Description of Artificial Sequence: Synthetic peptide
  MOD_RES (4)..(5): Any amino acid
TKVXXK

SEQ ID NO: 2797 - protein, 6 aa, Artificial Sequence
  Description of Artificial Sequence: Synthetic peptide
  MOD_RES (4)..(5): Any amino acid
CSAXXG

SEQ ID NO: 2798 - protein, 6 aa, Artificial Sequence
  Description of Artificial Sequence: Synthetic peptide
  MOD_RES (4)..(5): Any amino acid
PTWXXG

SEQ ID NO: 2799 - protein, 6 aa, Artificial Sequence
  Description of Artificial Sequence: Synthetic peptide
  MOD_RES (4)..(5): Any amino acid
SAGXXR

SEQ ID NO: 2800 - protein, 6 aa, Artificial Sequence
  Description of Artificial Sequence: Synthetic peptide
  MOD_RES (4)..(5): Any amino acid
QSPXXL

SEQ ID NO: 2801 - protein, 6 aa, Artificial Sequence
  Description of Artificial Sequence: Synthetic peptide
  MOD_RES (4)..(5): Any amino acid
YASXXT

SEQ ID NO: 2802 - protein, 6 aa, Artificial Sequence
  Description of Artificial Sequence: Synthetic peptide
  MOD_RES (4)..(5): Any amino acid
AAGXXT

SEQ ID NO: 2803 - protein, 6 aa, Artificial Sequence
  Description of Artificial Sequence: Synthetic peptide
  MOD_RES (4)..(5): Any amino acid
GLGXXI

SEQ ID NO: 2804 - protein, 6 aa, Artificial Sequence
  Description of Artificial Sequence: Synthetic peptide
  MOD_RES (4)..(5): Any amino acid
SSTXXD

SEQ ID NO: 2805 - protein, 6 aa, Artificial Sequence
  Description of Artificial Sequence: Synthetic peptide
  MOD_RES (4)..(5): Any amino acid
PGHXXL

SEQ ID NO: 2806 - protein, 6 aa, Artificial Sequence
  Description of Artificial Sequence: Synthetic peptide
  MOD_RES (4)..(5): Any amino acid
NTKXXK

SEQ ID NO: 2807 - protein, 6 aa, Artificial Sequence
  Description of Artificial Sequence: Synthetic peptide
  MOD_RES (4)..(5): Any amino acid
ACNXXS

SEQ ID NO: 2808 - protein, 6 aa, Artificial Sequence
  Description of Artificial Sequence: Synthetic peptide
  MOD_RES (4)..(5): Any amino acid
FHIXXI

SEQ ID NO: 2809 - protein, 6 aa, Artificial Sequence
  Description of Artificial Sequence: Synthetic peptide
  MOD_RES (4)..(5): Any amino acid
ADKXXP

SEQ ID NO: 2810 - protein, 6 aa, Artificial Sequence
  Description of Artificial Sequence: Synthetic peptide
  MOD_RES (4)..(5): Any amino acid
WGDXXI

SEQ ID NO: 2811 - protein, 6 aa, Artificial Sequence
  Description of Artificial Sequence: Synthetic peptide
  MOD_RES (4)..(5): Any amino acid
GVGXXS

SEQ ID NO: 2812 - protein, 6 aa, Artificial Sequence
  Description of Artificial Sequence: Synthetic peptide
  MOD_RES (4)..(5): Any amino acid
NPTXXE

SEQ ID NO: 2813 - protein, 6 aa, Artificial Sequence
  Description of Artificial Sequence: Synthetic peptide
  MOD_RES (4)..(5): Any amino acid
TGTXXT

SEQ ID NO: 2814 - protein, 6 aa, Artificial Sequence
  Description of Artificial Sequence: Synthetic peptide
  MOD_RES (4)..(5): Any amino acid
CKNXXT

SEQ ID NO: 2815 - protein, 6 aa, Artificial Sequence
  Description of Artificial Sequence: Synthetic peptide
  MOD_RES (4)..(5): Any amino acid
CSAXXG

SEQ ID NO: 2816 - protein, 6 aa, Artificial Sequence
  Description of Artificial Sequence: Synthetic peptide
  MOD_RES (4)..(5): Any amino acid
SWGXXC

SEQ ID NO: 2817 - protein, 6 aa, Artificial Sequence
  Description of Artificial Sequence: Synthetic peptide
  MOD_RES (4)..(5): Any amino acid
NAGXXT

SEQ ID NO: 2818 - protein, 6 aa, Artificial Sequence
  Description of Artificial Sequence: Synthetic peptide
  MOD_RES (4)..(5): Any amino acid
GAGXXT

SEQ ID NO: 2819 - protein, 6 aa, Artificial Sequence
  Description of Artificial Sequence: Synthetic peptide
  MOD_RES (4)..(5): Any amino acid
GVGXXA

SEQ ID NO: 2820 - protein, 6 aa, Artificial Sequence
  Description of Artificial Sequence: Synthetic peptide
  MOD_RES (4)..(5): Any amino acid
ATNXXV

SEQ ID NO: 2821 - protein, 6 aa, Artificial Sequence
  Description of Artificial Sequence: Synthetic peptide
  MOD_RES (4)..(5): Any amino acid
FPGXXA

SEQ ID NO: 2822 - protein, 6 aa, Artificial Sequence
  Description of Artificial Sequence: Synthetic peptide
  MOD_RES (4)..(5): Any amino acid
SSTXXT

SEQ ID NO: 2823 - protein, 6 aa, Artificial Sequence
  Description of Artificial Sequence: Synthetic peptide
  MOD_RES (4)..(5): Any amino acid
TVAXXE

SEQ ID NO: 2824 - protein, 6 aa, Artificial Sequence
  Description of Artificial Sequence: Synthetic peptide
  MOD_RES (4)..(5): Any amino acid
FTVXXN

SEQ ID NO: 2825 - protein, 6 aa, Artificial Sequence
  Description of Artificial Sequence: Synthetic peptide
  MOD_RES (4)..(5): Any amino acid
SAGXXR

SEQ ID NO: 2826 - protein, 6 aa, Artificial Sequence
  Description of Artificial Sequence: Synthetic peptide
  MOD_RES (4)..(5): Any amino acid
VSWXXG

SEQ ID NO: 2827 - protein, 6 aa, Artificial Sequence
  Description of Artificial Sequence: Synthetic peptide
  MOD_RES (4)..(5): Any amino acid
CEGXXY

SEQ ID NO: 2828 - protein, 6 aa, Artificial Sequence
  Description of Artificial Sequence: Synthetic peptide
  MOD_RES (4)..(5): Any amino acid
QTGXXK

SEQ ID NO: 2829 - protein, 6 aa, Artificial Sequence
  Description of Artificial Sequence: Synthetic peptide
  MOD_RES (4)..(5): Any amino acid
DNAXXT

SEQ ID NO: 2830 - protein, 6 aa, Artificial Sequence
  Description of Artificial Sequence: Synthetic peptide
  MOD_RES (4)..(5): Any amino acid
NWGXXV

SEQ ID NO: 2831 - protein, 6 aa, Artificial Sequence
  Description of Artificial Sequence: Synthetic peptide
  MOD_RES (4)..(5): Any amino acid
SCQXXS

SEQ ID NO: 2832 - protein, 6 aa, Artificial Sequence
  Description of Artificial Sequence: Synthetic peptide
  MOD_RES (4)..(5): Any amino acid
KETXXA

SEQ ID NO: 2833 - protein, 6 aa, Artificial Sequence
  Description of Artificial Sequence: Synthetic peptide
  MOD_RES (4)..(5): Any amino acid
NYTXXL

SEQ ID NO: 2834 - protein, 6 aa, Artificial Sequence
  Description of Artificial Sequence: Synthetic peptide
  MOD_RES (4)..(5): Any amino acid
CLGXXC

SEQ ID NO: 2835 - protein, 6 aa, Artificial Sequence
  Description of Artificial Sequence: Synthetic peptide
  MOD_RES (4)..(5): Any amino acid
SGVXXS

SEQ ID NO: 2836 - protein, 6 aa, Artificial Sequence
  Description of Artificial Sequence: Synthetic peptide
  MOD_RES (4)..(5): Any amino acid
GYSXXN

SEQ ID NO: 2837 - protein, 6 aa, Artificial Sequence
  Description of Artificial Sequence: Synthetic peptide
  MOD_RES (4)..(5): Any amino acid
LDNXXK

SEQ ID NO: 2838 - protein, 6 aa, Artificial Sequence
  Description of Artificial Sequence: Synthetic peptide
  MOD_RES (4)..(5): Any amino acid
RIVXXT

SEQ ID NO: 2839 - protein, 6 aa, Artificial Sequence
  Description of Artificial Sequence: Synthetic peptide
  MOD_RES (4)..(5): Any amino acid
DAAXXT

SEQ ID NO: 2840 - protein, 6 aa, Artificial Sequence
  Description of Artificial Sequence: Synthetic peptide
  MOD_RES (4)..(5): Any amino acid
GTGXXF

SEQ ID NO: 2841 - protein, 6 aa, Artificial Sequence
  Description of Artificial Sequence: Synthetic peptide
  MOD_RES (4)..(5): Any amino acid
LGNXXR

SEQ ID NO: 2842 - protein, 6 aa, Artificial Sequence
  Description of Artificial Sequence: Synthetic peptide
  MOD_RES (4)..(5): Any amino acid
HLCXXH

SEQ ID NO: 2843 - protein, 6 aa, Artificial Sequence
  Description of Artificial Sequence: Synthetic peptide
  MOD_RES (4)..(5): Any amino acid
NQTXXR

SEQ ID NO: 2844 - protein, 6 aa, Artificial Sequence
  Description of Artificial Sequence: Synthetic peptide
  MOD_RES (4)..(5): Any amino acid
IVNXXP

SEQ ID NO: 2845 - protein, 6 aa, Artificial Sequence
  Description of Artificial Sequence: Synthetic peptide
  MOD_RES (4)..(5): Any amino acid
SPGXXR

SEQ ID NO: 2846 - protein, 6 aa, Artificial Sequence
  Description of Artificial Sequence: Synthetic peptide
  MOD_RES (4)..(5): Any amino acid
QGSXXT

SEQ ID NO: 2847 - protein, 6 aa, Artificial Sequence
  Description of Artificial Sequence: Synthetic peptide
  MOD_RES (4)..(5): Any amino acid
MELXXL

SEQ ID NO: 2848 - protein, 6 aa, Artificial Sequence
  Description of Artificial Sequence: Synthetic peptide
  MOD_RES (4)..(5): Any amino acid
NVGXXS

SEQ ID NO: 2849 - protein, 6 aa, Artificial Sequence
  Description of Artificial Sequence: Synthetic peptide
  MOD_RES (4)..(5): Any amino acid
ENDXXG

SEQ ID NO: 2850 - protein, 6 aa, Artificial Sequence
  Description of Artificial Sequence: Synthetic peptide
  MOD_RES (4)..(5): Any amino acid
GIPXXQ

SEQ ID NO: 2851 - protein, 6 aa, Artificial Sequence
  Description of Artificial Sequence: Synthetic peptide
  MOD_RES (4)..(5): Any amino acid
KTTXXY

SEQ ID NO: 2852 - protein, 6 aa, Artificial Sequence
  Description of Artificial Sequence: Synthetic peptide
  MOD_RES (4)..(5): Any amino acid
FPEXXT

SEQ ID NO: 2853 - protein, 6 aa, Artificial Sequence
  Description of Artificial Sequence: Synthetic peptide
  MOD_RES (4)..(5): Any amino acid
TGDXXG

SEQ ID NO: 2854 - protein, 6 aa, Artificial Sequence
  Description of Artificial Sequence: Synthetic peptide
  MOD_RES (4)..(5): Any amino acid
DACXXD

SEQ ID NO: 2855 - protein, 6 aa, Artificial Sequence
  Description of Artificial Sequence: Synthetic peptide
  MOD_RES (4)..(5): Any amino acid
GISXXT

SEQ ID NO: 2856 - protein, 6 aa, Artificial Sequence
  Description of Artificial Sequence: Synthetic peptide
  MOD_RES (4)..(5): Any amino acid
NMDXXE

SEQ ID NO: 2857 - protein, 6 aa, Artificial Sequence
  Description of Artificial Sequence: Synthetic peptide
  MOD_RES (4)..(5): Any amino acid
TQSXXS

SEQ ID NO: 2858 - protein, 6 aa, Artificial Sequence
  Description of Artificial Sequence: Synthetic peptide
  MOD_RES (4)..(5): Any amino acid
GLSXXI

SEQ ID NO: 2859 - protein, 6 aa, Artificial Sequence
  Description of Artificial Sequence: Synthetic peptide
  MOD_RES (4)..(5): Any amino acid
SESXXH

SEQ ID NO: 2860 - protein, 6 aa, Artificial Sequence
  Description of Artificial Sequence: Synthetic peptide
  MOD_RES (4)..(5): Any amino acid
GHGXXT

SEQ ID NO: 2861 - protein, 6 aa, Artificial Sequence
  Description of Artificial Sequence: Synthetic peptide
  MOD_RES (4)..(5): Any amino acid
NVAXXN

SEQ ID NO: 2862 - protein, 6 aa, Artificial Sequence
  Description of Artificial Sequence: Synthetic peptide
  MOD_RES (4)..(5): Any amino acid
ACQXXS

SEQ ID NO: 2863 - protein, 6 aa, Artificial Sequence
  Description of Artificial Sequence: Synthetic peptide
  MOD_RES (4)..(5): Any amino acid
PSGXXK

SEQ ID NO: 2864 - protein, 6 aa, Artificial Sequence
  Description of Artificial Sequence: Synthetic peptide
  MOD_RES (4)..(5): Any amino acid
GQGXXS

SEQ ID NO: 2865 - protein, 6 aa, Artificial Sequence
  Description of Artificial Sequence: Synthetic peptide
  MOD_RES (4)..(5): Any amino acid
DGGXXK

SEQ ID NO: 2866 - protein, 6 aa, Artificial Sequence
  Description of Artificial Sequence: Synthetic peptide
  MOD_RES (4)..(5): Any amino acid
FQLXXE

SEQ ID NO: 2867 - protein, 6 aa, Artificial Sequence
  Description of Artificial Sequence: Synthetic peptide
  MOD_RES (4)..(5): Any amino acid
TGDXXC

SEQ ID NO: 2868 - protein, 6 aa, Artificial Sequence
  Description of Artificial Sequence: Synthetic peptide
  MOD_RES (4)..(5): Any amino acid
NSGXXT

SEQ ID NO: 2869 - protein, 6 aa, Artificial Sequence
  Description of Artificial Sequence: Synthetic peptide
  MOD_RES (4)..(5): Any amino acid
HHMXXP

SEQ ID NO: 2870 - protein, 6 aa, Artificial Sequence
  Description of Artificial Sequence: Synthetic peptide
  MOD_RES (4)..(5): Any amino acid
EFDXXD

SEQ ID NO: 2871 - protein, 6 aa, Artificial Sequence
  Description of Artificial Sequence: Synthetic peptide
  MOD_RES (4)..(5): Any amino acid
SCKXXT

SEQ ID NO: 2872 - protein, 6 aa, Artificial Sequence
  Description of Artificial Sequence: Synthetic peptide
  MOD_RES (4)..(5): Any amino acid
FSTXXR

SEQ ID NO: 2873 - protein, 6 aa, Artificial Sequence
  Description of Artificial Sequence: Synthetic peptide
  MOD_RES (4)..(5): Any amino acid
RETXXS

SEQ ID NO: 2874 - protein, 6 aa, Artificial Sequence
  Description of Artificial Sequence: Synthetic peptide
  MOD_RES (4)..(5): Any amino acid
QGQXXG

SEQ ID NO: 2875 - protein, 6 aa, Artificial Sequence
  Description of Artificial Sequence: Synthetic peptide
  MOD_RES (4)..(5): Any amino acid
VTCXXG

SEQ ID NO: 2876 - protein, 6 aa, Artificial Sequence
  Description of Artificial Sequence: Synthetic peptide
  MOD_RES (4)..(5): Any amino acid
PNRXXR

SEQ ID NO: 2877 - protein, 6 aa, Artificial Sequence
  Description of Artificial Sequence: Synthetic peptide
  MOD_RES (4)..(5): Any amino acid
KNVXXK

SEQ ID NO: 2878 - protein, 6 aa, Artificial Sequence
  Description of Artificial Sequence: Synthetic peptide
  MOD_RES (4)..(5): Any amino acid
KELXXY

SEQ ID NO: 2879 - protein, 6 aa, Artificial Sequence
  Description of Artificial Sequence: Synthetic peptide
  MOD_RES (4)..(5): Any amino acid
KCKXXH

SEQ ID NO: 2880 - protein, 6 aa, Artificial Sequence
  Description of Artificial Sequence: Synthetic peptide
  MOD_RES (4)..(5): Any amino acid
IYRXXL

SEQ ID NO: 2881 - protein, 6 aa, Artificial Sequence
  Description of Artificial Sequence: Synthetic peptide
  MOD_RES (4)..(5): Any amino acid
STVXXT

SEQ ID NO: 2882 - protein, 6 aa, Artificial Sequence
  Description of Artificial Sequence: Synthetic peptide
  MOD_RES (4)..(5): Any amino acid
SAAXXR

SEQ ID NO: 2883 - protein, 6 aa, Artificial Sequence
  Description of Artificial Sequence: Synthetic peptide
  MOD_RES (4)..(5): Any amino acid
GFSXXD

SEQ ID NO: 2884 - protein, 6 aa, Artificial Sequence
  Description of Artificial Sequence: Synthetic peptide
  MOD_RES (4)..(5): Any amino acid
QPGXXQ

SEQ ID NO: 2885 - protein, 6 aa, Artificial Sequence
  Description of Artificial Sequence: Synthetic peptide
  MOD_RES (4)..(5): Any amino acid
EYAXXG

SEQ ID NO: 2886 - protein, 6 aa, Artificial Sequence
  Description of Artificial Sequence: Synthetic peptide
  MOD_RES (4)..(5): Any amino acid
QHFXXL

SEQ ID NO: 2887 - protein, 6 aa, Artificial Sequence
  Description of Artificial Sequence: Synthetic peptide
  MOD_RES (4)..(5): Any amino acid
PNGXXK

SEQ ID NO: 2888 - protein, 6 aa, Artificial Sequence
  Description of Artificial Sequence: Synthetic peptide
  MOD_RES (4)..(5): Any amino acid
PTEXXL

SEQ ID NO: 2889 - protein, 6 aa, Artificial Sequence
  Description of Artificial Sequence: Synthetic peptide
  MOD_RES (4)..(5): Any amino acid
PSSXXA

SEQ ID NO: 2890 - protein, 6 aa, Artificial Sequence
  Description of Artificial Sequence: Synthetic peptide
  MOD_RES (4)..(4): Any amino acid
STKXDK

SEQ ID NO: 2891 - protein, 6 aa, Artificial Sequence
  Description of Artificial Sequence: Synthetic peptide
  MOD_RES (4)..(4): Any amino acid
TKVXKK

SEQ ID NO: 2892 - protein, 6 aa, Artificial Sequence
  Description of Artificial Sequence: Synthetic peptide
  MOD_RES (4)..(4): Any amino acid
SAGXGR

SEQ ID NO: 2893 - protein, 6 aa, Artificial Sequence
  Description of Artificial Sequence: Synthetic peptide
  MOD_RES (4)..(4): Any amino acid
SSTXVD

SEQ ID NO: 2894 - protein, 6 aa, Artificial Sequence
  Description of Artificial Sequence: Synthetic peptide
  MOD_RES (4)..(4): Any amino acid
CSAXIG

SEQ ID NO: 2895 - protein, 6 aa, Artificial Sequence
  Description of Artificial Sequence: Synthetic peptide
  MOD_RES (4)..(4): Any amino acid
TQTXKT

SEQ ID NO: 2896 - protein, 6 aa, Artificial Sequence
  Description of Artificial Sequence: Synthetic peptide
  MOD_RES (4)..(4): Any amino acid
GSGXST

SEQ ID NO: 2897 - protein, 6 aa, Artificial Sequence
  Description of Artificial Sequence: Synthetic peptide
  MOD_RES (4)..(4): Any amino acid
NTKXDK

SEQ ID NO: 2898 - protein, 6 aa, Artificial Sequence
  Description of Artificial Sequence: Synthetic peptide
  MOD_RES (4)..(4): Any amino acid
VACXNG

SEQ ID NO: 2899 - protein, 6 aa, Artificial Sequence
  Description of Artificial Sequence: Synthetic peptide
  MOD_RES (4)..(4): Any amino acid
YASXRT

SEQ ID NO: 2900 - protein, 6 aa, Artificial Sequence
  Description of Artificial Sequence: Synthetic peptide
  MOD_RES (4)..(4): Any amino acid
CSAXVG

SEQ ID NO: 2901 - protein, 6 aa, Artificial Sequence
  Description of Artificial Sequence: Synthetic peptide
  MOD_RES (4)..(4): Any amino acid
TGTXKT

SEQ ID NO: 2902 - protein, 6 aa, Artificial Sequence
  Description of Artificial Sequence: Synthetic peptide
  MOD_RES (4)..(4): Any amino acid
SAGXGR

SEQ ID NO: 2903 - protein, 6 aa, Artificial Sequence
  Description of Artificial Sequence: Synthetic peptide
  MOD_RES (4)..(4): Any amino acid
NAGXTT

SEQ ID NO: 2904 - protein, 6 aa, Artificial Sequence
  Description of Artificial Sequence: Synthetic peptide
  MOD_RES (4)..(4): Any amino acid
PTWXIG

SEQ ID NO: 2905 - protein, 6 aa, Artificial Sequence
  Description of Artificial Sequence: Synthetic peptide
  MOD_RES (4)..(4): Any amino acid
HIAXVA

SEQ ID NO: 2906 - protein, 6 aa, Artificial Sequence
  Description of Artificial Sequence: Synthetic peptide
  MOD_RES (4)..(4): Any amino acid
DASXNT

SEQ ID NO: 2907 - protein, 6 aa, Artificial Sequence
  Description of Artificial Sequence: Synthetic peptide
  MOD_RES (4)..(4): Any amino acid
GTMXPV

SEQ ID NO: 2908 - protein, 6 aa, Artificial Sequence
  Description of Artificial Sequence: Synthetic peptide
  MOD_RES (4)..(4): Any amino acid
GPEXSF

SEQ ID NO: 2909 - protein, 6 aa, Artificial Sequence
  Description of Artificial Sequence: Synthetic peptide
  MOD_RES (4)..(4): Any amino acid
GYRXNG

SEQ ID NO: 2910 - protein, 6 aa, Artificial Sequence
  Description of Artificial Sequence: Synthetic peptide
  MOD_RES (4)..(4): Any amino acid
DNAXKT

SEQ ID NO: 2911 - protein, 6 aa, Artificial Sequence
  Description of Artificial Sequence: Synthetic peptide
  MOD_RES (4)..(4): Any amino acid
CLGXIC

SEQ ID NO: 2912 - protein, 6 aa, Artificial Sequence
  Description of Artificial Sequence: Synthetic peptide
  MOD_RES (4)..(4): Any amino acid
LDNXGK

SEQ ID NO: 2913 - protein, 6 aa, Artificial Sequence
  Description of Artificial Sequence: Synthetic peptide
  MOD_RES (4)..(4): Any amino acid
AAGXTT

SEQ ID NO: 2914 - protein, 6 aa, Artificial Sequence
  Description of Artificial Sequence: Synthetic peptide
  MOD_RES (4)..(4): Any amino acid
SWGXGC

SEQ ID NO: 2915 - protein, 6 aa, Artificial Sequence
  Description of Artificial Sequence: Synthetic peptide
  MOD_RES (4)..(4): Any amino acid
GVGXSA

SEQ ID NO: 2916 - protein, 6 aa, Artificial Sequence
  Description of Artificial Sequence: Synthetic peptide
  MOD_RES (4)..(4): Any amino acid
DAAXKT

SEQ ID NO: 2917 - protein, 6 aa, Artificial Sequence
  Description of Artificial Sequence: Synthetic peptide
  MOD_RES (4)..(4): Any amino acid
IVNXTP

SEQ ID NO: 2918 - protein, 6 aa, Artificial Sequence
  Description of Artificial Sequence: Synthetic peptide
  MOD_RES (4)..(4): Any amino acid
PGHXAL

SEQ ID NO: 2919 - protein, 6 aa, Artificial Sequence
  Description of Artificial Sequence: Synthetic peptide
  MOD_RES (4)..(4): Any amino acid
LGNXCR

SEQ ID NO: 2920 - protein, 6 aa, Artificial Sequence
  Description of Artificial Sequence: Synthetic peptide
  MOD_RES (4)..(4): Any amino acid
ACNXDS

SEQ ID NO: 2921 - protein, 6 aa, Artificial Sequence
  Description of Artificial Sequence: Synthetic peptide
  MOD_RES (4)..(4): Any amino acid
CSAXIG

SEQ ID NO: 2922 - protein, 6 aa, Artificial Sequence
  Description of Artificial Sequence: Synthetic peptide
  MOD_RES (4)..(4): Any amino acid
SGVXKS

SEQ ID NO: 2923 - protein, 6 aa, Artificial Sequence
  Description of Artificial Sequence: Synthetic peptide
  MOD_RES (4)..(4): Any amino acid
GTGXTF

SEQ ID NO: 2924 - protein, 6 aa, Artificial Sequence
  Description of Artificial Sequence: Synthetic peptide
  MOD_RES (4)..(4): Any amino acid
QTGXGK

SEQ ID NO: 2925 - protein, 6 aa, Artificial Sequence
  Description of Artificial Sequence: Synthetic peptide
  MOD_RES (4)..(4): Any amino acid
DGGXGK

SEQ ID NO: 2926 - protein, 6 aa, Artificial Sequence
  Description of Artificial Sequence: Synthetic peptide
  MOD_RES (4)..(4): Any amino acid
QGSXKT

SEQ ID NO: 2927 - protein, 6 aa, Artificial Sequence
  Description of Artificial Sequence: Synthetic peptide
  MOD_RES (4)..(4): Any amino acid
GSGXTT

SEQ ID NO: 2928 - protein, 6 aa, Artificial Sequence
  Description of Artificial Sequence: Synthetic peptide
  MOD_RES (4)..(4): Any amino acid
GAGXTT

SEQ ID NO: 2929 - protein, 6 aa, Artificial Sequence
  Description of Artificial Sequence: Synthetic peptide
  MOD_RES (4)..(4): Any amino acid
GVGXSS

SEQ ID NO: 2930 - protein, 6 aa, Artificial Sequence
  Description of Artificial Sequence: Synthetic peptide
  MOD_RES (4)..(4): Any amino acid
QSPXSL

SEQ ID NO: 2931 - protein, 6 aa, Artificial Sequence
  Description of Artificial Sequence: Synthetic peptide
  MOD_RES (4)..(4): Any amino acid
SSTXNT

SEQ ID NO: 2932 - protein, 6 aa, Artificial Sequence
  Description of Artificial Sequence: Synthetic peptide
  MOD_RES (4)..(4): Any amino acid
RIVXYT

SEQ ID NO: 2933 - protein, 6 aa, Artificial Sequence
  Description of Artificial Sequence: Synthetic peptide
  MOD_RES (4)..(4): Any amino acid
PSGXGK

SEQ ID NO: 2934 - protein, 6 aa, Artificial Sequence
  Description of Artificial Sequence: Synthetic peptide
  MOD_RES (4)..(4): Any amino acid
PNGXGK

SEQ ID NO: 2935 - protein, 6 aa, Artificial Sequence
  Description of Artificial Sequence: Synthetic peptide
  MOD_RES (4)..(4): Any amino acid
KNVXCK

SEQ ID NO: 2936 - protein, 6 aa, Artificial Sequence
  Description of Artificial Sequence: Synthetic peptide
  MOD_RES (4)..(4): Any amino acid
GAGXTS

SEQ ID NO: 2937 - protein, 6 aa, Artificial Sequence
  Description of Artificial Sequence: Synthetic peptide
  MOD_RES (4)..(4): Any amino acid
AKRXNF

SEQ ID NO: 2938 - protein, 6 aa, Artificial Sequence
  Description of Artificial Sequence: Synthetic peptide
  MOD_RES (4)..(4): Any amino acid
NQTXNR

SEQ ID NO: 2939 - protein, 6 aa, Artificial Sequence
  Description of Artificial Sequence: Synthetic peptide
  MOD_RES (4)..(4): Any amino acid
VSWXRG

SEQ ID NO: 2940 - protein, 6 aa, Artificial Sequence
  Description of Artificial Sequence: Synthetic peptide
  MOD_RES (4)..(4): Any amino acid
GLGXSI

SEQ ID NO: 2941 - protein, 6 aa, Artificial Sequence
  Description of Artificial Sequence: Synthetic peptide
  MOD_RES (4)..(4): Any amino acid
ATNXRV

SEQ ID NO: 2942 - protein, 6 aa, Artificial Sequence
  Description of Artificial Sequence: Synthetic peptide
  MOD_RES (4)..(4): Any amino acid
FPEXLT

SEQ ID NO: 2943 - protein, 6 aa, Artificial Sequence
  Description of Artificial Sequence: Synthetic peptide
  MOD_RES (4)..(4): Any amino acid
GVGXSN

SEQ ID NO: 2944 - protein, 6 aa, Artificial Sequence
  Description of Artificial Sequence: Synthetic peptide
  MOD_RES (4)..(4): Any amino acid
MELXTL

SEQ ID NO: 2945 - protein, 6 aa, Artificial Sequence
  Description of Artificial Sequence: Synthetic peptide
  MOD_RES (4)..(4): Any amino acid
LGFXIV

SEQ ID NO: 2946 - protein, 6 aa, Artificial Sequence
  Description of Artificial Sequence: Synthetic peptide
  MOD_RES (4)..(4): Any amino acid
GQGXMS

SEQ ID NO: 2947 - protein, 6 aa, Artificial Sequence
  Description of Artificial Sequence: Synthetic peptide
  MOD_RES (4)..(4): Any amino acid
QGQXIM

SEQ ID NO: 2948 - protein, 6 aa, Artificial Sequence
  Description of Artificial Sequence: Synthetic peptide
  MOD_RES (4)..(4): Any amino acid
LNVXMV

SEQ ID NO: 2949 - protein, 6 aa, Artificial Sequence
  Description of Artificial Sequence: Synthetic peptide
  MOD_RES (4)..(4): Any amino acid
DACXGD

SEQ ID NO: 2950 - protein, 6 aa, Artificial Sequence
  Description of Artificial Sequence: Synthetic peptide
  MOD_RES (4)..(4): Any amino acid
NVAXKN

SEQ ID NO: 2951 - protein, 6 aa, Artificial Sequence
  Description of Artificial Sequence: Synthetic peptide
  MOD_RES (4)..(4): Any amino acid
GLSXLI

SEQ ID NO: 2952 - protein, 6 aa, Artificial Sequence
  Description of Artificial Sequence: Synthetic peptide
  MOD_RES (4)..(4): Any amino acid
TVAXNE

SEQ ID NO: 2953 - protein, 6 aa, Artificial Sequence
  Description of Artificial Sequence: Synthetic peptide
  MOD_RES (4)..(4): Any amino acid
QCGXCW

SEQ ID NO: 2954 - protein, 6 aa, Artificial Sequence
  Description of Artificial Sequence: Synthetic peptide
  MOD_RES (4)..(4): Any amino acid
WGHXYA

SEQ ID NO: 2955 - protein, 6 aa, Artificial Sequence
  Description of Artificial Sequence: Synthetic peptide
  MOD_RES (4)..(4): Any amino acid
WKNXFT

SEQ ID NO: 2956 - protein, 6 aa, Artificial Sequence
  Description of Artificial Sequence: Synthetic peptide
  MOD_RES (4)..(4): Any amino acid
DSGXGK

SEQ ID NO: 2957 - protein, 6 aa, Artificial Sequence
  Description of Artificial Sequence: Synthetic peptide
  MOD_RES (4)..(4): Any amino acid
NSGXTT

SEQ ID NO: 2958 - protein, 6 aa, Artificial Sequence
  Description of Artificial Sequence: Synthetic peptide
  MOD_RES (4)..(4): Any amino acid
GGTXKT

SEQ ID NO: 2959 - protein, 6 aa, Artificial Sequence
  Description of Artificial Sequence: Synthetic peptide
  MOD_RES (4)..(4): Any amino acid
QCGXCW

SEQ ID NO: 2960 - protein, 6 aa, Artificial Sequence
  Description of Artificial Sequence: Synthetic peptide
  MOD_RES (4)..(4): Any amino acid
VEFXFP

SEQ ID NO: 2961 - protein, 6 aa, Artificial Sequence
  Description of Artificial Sequence: Synthetic peptide
  MOD_RES (4)..(4): Any amino acid
GSTXEK

SEQ ID NO: 2962 - protein, 6 aa, Artificial Sequence
  Description of Artificial Sequence: Synthetic peptide
  MOD_RES (4)..(4): Any amino acid
KCKXCH

SEQ ID NO: 2963 - protein, 6 aa, Artificial Sequence
  Description of Artificial Sequence: Synthetic peptide
  MOD_RES (4)..(4): Any amino acid
EFTXPD

SEQ ID NO: 2964 - protein, 6 aa, Artificial Sequence
  Description of Artificial Sequence: Synthetic peptide
  MOD_RES (4)..(4): Any amino acid
GGVXKS

SEQ ID NO: 2965 - protein, 6 aa, Artificial Sequence
  Description of Artificial Sequence: Synthetic peptide
  MOD_RES (4)..(4): Any amino acid
YGFXLH

SEQ ID NO: 2966 - protein, 6 aa, Artificial Sequence
  Description of Artificial Sequence: Synthetic peptide
  MOD_RES (4)..(4): Any amino acid
GVGXTS

SEQ ID NO: 2967 - protein, 6 aa, Artificial Sequence
  Description of Artificial Sequence: Synthetic peptide
  MOD_RES (4)..(4): Any amino acid
YTPXLP

SEQ ID NO: 2968 - protein, 6 aa, Artificial Sequence
  Description of Artificial Sequence: Synthetic peptide
  MOD_RES (4)..(4): Any amino acid
VDHXKT

SEQ ID NO: 2969 - protein, 6 aa, Artificial Sequence
  Description of Artificial Sequence: Synthetic peptide
  MOD_RES (4)..(4): Any amino acid
QRRXLG

SEQ ID NO: 2970 - protein, 6 aa, Artificial Sequence
  Description of Artificial Sequence: Synthetic peptide
  MOD_RES (4)..(4): Any amino acid
GISXET

SEQ ID NO: 2971 - protein, 6 aa, Artificial Sequence
  Description of Artificial Sequence: Synthetic peptide
  MOD_RES (4)..(4): Any amino acid
DHGXTT

SEQ ID NO: 2972 - protein, 6 aa, Artificial Sequence
  Description of Artificial Sequence: Synthetic peptide
  MOD_RES (4)..(4): Any amino acid
SGSXKS

SEQ ID NO: 2973 - protein, 6 aa, Artificial Sequence
  Description of Artificial Sequence: Synthetic peptide
  MOD_RES (4)..(4): Any amino acid
HHMXLP

SEQ ID NO: 2974 - protein, 6 aa, Artificial Sequence
  Description of Artificial Sequence: Synthetic peptide
  MOD_RES (4)..(4): Any amino acid
INGXSA

SEQ ID NO: 2975 - protein, 6 aa, Artificial Sequence
  Description of Artificial Sequence: Synthetic peptide
  MOD_RES (4)..(4): Any amino acid
AGTXKS

SEQ ID NO: 2976 - protein, 6 aa, Artificial Sequence
  Description of Artificial Sequence: Synthetic peptide
  MOD_RES (4)..(4): Any amino acid
ELGXLR

SEQ ID NO: 2977 - protein, 6 aa, Artificial Sequence
  Description of Artificial Sequence: Synthetic peptide
  MOD_RES (4)..(4): Any amino acid
TWNXGE

SEQ ID NO: 2978 - protein, 6 aa, Artificial Sequence
  Description of Artificial Sequence: Synthetic peptide
  MOD_RES (4)..(4): Any amino acid
GLTXWK

SEQ ID NO: 2979 - protein, 6 aa, Artificial Sequence
  Description of Artificial Sequence: Synthetic peptide
  MOD_RES (4)..(4): Any amino acid
PLRXFK

SEQ ID NO: 2980 - protein, 6 aa, Artificial Sequence
  Description of Artificial Sequence: Synthetic peptide
  MOD_RES (4)..(4): Any amino acid
ALDXPD

SEQ ID NO: 2981 - protein, 6 aa, Artificial Sequence
  Description of Artificial Sequence: Synthetic peptide
  MOD_RES (4)..(4): Any amino acid
RVEXTF

SEQ ID NO: 2982 - protein, 6 aa, Artificial Sequence
  Description of Artificial Sequence: Synthetic peptide
  MOD_RES (4)..(4): Any amino acid
THCXVH

SEQ ID NO: 2983 - protein, 6 aa, Artificial Sequence
  Description of Artificial Sequence: Synthetic peptide
  MOD_RES (4)..(4): Any amino acid
GSGXGT

SEQ ID NO: 2984 - protein, 6 aa, Artificial Sequence
  Description of Artificial Sequence: Synthetic peptide
  MOD_RES (4)..(4): Any amino acid
LGPXRS

SEQ ID NO: 2985 - protein, 6 aa, Artificial Sequence
  Description of Artificial Sequence: Synthetic peptide
  MOD_RES (4)..(4): Any amino acid
AAGXST

SEQ ID NO: 2986 - protein, 6 aa, Artificial Sequence
  Description of Artificial Sequence: Synthetic peptide
  MOD_RES (4)..(4): Any amino acid
TLKXET

SEQ ID NO: 2987 - protein, 6 aa, Artificial Sequence
  Description of Artificial Sequence: Synthetic peptide
  MOD_RES (4)..(4): Any amino acid
PGSXKG

SEQ ID NO: 2988 - protein, 6 aa, Artificial Sequence
  Description of Artificial Sequence: Synthetic peptide
  MOD_RES (4)..(4): Any amino acid
IYRXRL

SEQ ID NO: 2989 - protein, 6 aa, Artificial Sequence
  Description of Artificial Sequence: Synthetic peptide
  MOD_RES (5)..(5): Any amino acid
STKVXK

SEQ ID NO: 2990 - protein, 6 aa, Artificial Sequence
  Description of Artificial Sequence: Synthetic peptide
  MOD_RES (5)..(5): Any amino acid
GSGKXT

SEQ ID NO: 2991 - protein, 6 aa, Artificial Sequence
  Description of Artificial Sequence: Synthetic peptide
  MOD_RES (5)..(5): Any amino acid
TKVDXK

SEQ ID NO: 2992 - protein, 6 aa, Artificial Sequence
  Description of Artificial Sequence: Synthetic peptide
  MOD_RES (5)..(5): Any amino acid
VACKXG

SEQ ID NO: 2993 - protein, 6 aa, Artificial Sequence
  Description of Artificial Sequence: Synthetic peptide
  MOD_RES (5)..(5): Any amino acid
TQTGXT

SEQ ID NO: 2994 - protein, 6 aa, Artificial Sequence
  Description of Artificial Sequence: Synthetic peptide
  MOD_RES (5)..(5): Any amino acid
CSAGXG

SEQ ID NO: 2995 - protein, 6 aa, Artificial Sequence
  Description of Artificial Sequence: Synthetic peptide
  MOD_RES (5)..(5): Any amino acid
SSTKXD

SEQ ID NO: 2996 - protein, 6 aa, Artificial Sequence
  Description of Artificial Sequence: Synthetic peptide
  MOD_RES (5)..(5): Any amino acid
AAGKXT

SEQ ID NO: 2997 - protein, 6 aa, Artificial Sequence
  Description of Artificial Sequence: Synthetic peptide
  MOD_RES (5)..(5): Any amino acid
NTKVXK

SEQ ID NO: 2998 - protein, 6 aa, Artificial Sequence
  Description of Artificial Sequence: Synthetic peptide
  MOD_RES (5)..(5): Any amino acid
GVGKXS

SEQ ID NO: 2999 - protein, 6 aa, Artificial Sequence
  Description of Artificial Sequence: Synthetic peptide
  MOD_RES (5)..(5): Any amino acid
FPGHXA

SEQ ID NO: 3000 - protein, 6 aa, Artificial Sequence
  Description of Artificial Sequence: Synthetic peptide
  MOD_RES (5)..(5): Any amino acid
GAGKXT

SEQ ID NO: 3001 - protein, 6 aa, Artificial Sequence
  Description of Artificial Sequence: Synthetic peptide
  MOD_RES (5)..(5): Any amino acid
YASGXT

SEQ ID NO: 3002 - protein, 6 aa, Artificial Sequence
  Description of Artificial Sequence: Synthetic peptide
  MOD_RES (5)..(5): Any amino acid
GVGKXA

SEQ ID NO: 3003 - protein, 6 aa, Artificial Sequence
  Description of Artificial Sequence: Synthetic peptide
  MOD_RES (5)..(5): Any amino acid
SAGIXR

SEQ ID NO: 3004 - protein, 6 aa, Artificial Sequence
  Description of Artificial Sequence: Synthetic peptide
  MOD_RES (5)..(5): Any amino acid
PTWNXG

SEQ ID NO: 3005 - protein, 6 aa, Artificial Sequence
  Description of Artificial Sequence: Synthetic peptide
  MOD_RES (5)..(5): Any amino acid
DNAGXT

SEQ ID NO: 3006 - protein, 6 aa, Artificial Sequence
  Description of Artificial Sequence: Synthetic peptide
  MOD_RES (5)..(5): Any amino acid
CSAGXG

SEQ ID NO: 3007 - protein, 6 aa, Artificial Sequence
  Description of Artificial Sequence: Synthetic peptide
  MOD_RES (5)..(5): Any amino acid
SAGVXR

SEQ ID NO: 3008 - protein, 6 aa, Artificial Sequence
  Description of Artificial Sequence: Synthetic peptide
  MOD_RES (5)..(5): Any amino acid
VSWGXG

SEQ ID NO: 3009 - protein, 6 aa, Artificial Sequence
  Description of Artificial Sequence: Synthetic peptide
  MOD_RES (5)..(5): Any amino acid
NAGKXT

SEQ ID NO: 3010 - protein, 6 aa, Artificial Sequence
  Description of Artificial Sequence: Synthetic peptide
  MOD_RES (5)..(5): Any amino acid
GLGFXI

SEQ ID NO: 3011 - protein, 6 aa, Artificial Sequence
  Description of Artificial Sequence: Synthetic peptide
  MOD_RES (5)..(5): Any amino acid
TGGAXI

SEQ ID NO: 3012 - protein, 6 aa, Artificial Sequence
  Description of Artificial Sequence: Synthetic peptide
  MOD_RES (5)..(5): Any amino acid
RYTQXN

SEQ ID NO: 3013 - protein, 6 aa, Artificial Sequence
  Description of Artificial Sequence: Synthetic peptide
  MOD_RES (5)..(5): Any amino acid
SLPTXD

SEQ ID NO: 3014 - protein, 6 aa, Artificial Sequence
  Description of Artificial Sequence: Synthetic peptide
  MOD_RES (5)..(5): Any amino acid
ALASXA

SEQ ID NO: 3015 - protein, 6 aa, Artificial Sequence
  Description of Artificial Sequence: Synthetic peptide
  MOD_RES (5)..(5): Any amino acid
FHISXI

SEQ ID NO: 3016 - protein, 6 aa, Artificial Sequence
  Description of Artificial Sequence: Synthetic peptide
  MOD_RES (5)..(5): Any amino acid
ADKLXP

SEQ ID NO: 3017 - protein, 6 aa, Artificial Sequence
  Description of Artificial Sequence: Synthetic peptide
  MOD_RES (5)..(5): Any amino acid
LSERXT

SEQ ID NO: 3018 - protein, 6 aa, Artificial Sequence
  Description of Artificial Sequence: Synthetic peptide
  MOD_RES (5)..(5): Any amino acid
ELTSXE

SEQ ID NO: 3019 - protein, 6 aa, Artificial Sequence
  Description of Artificial Sequence: Synthetic peptide
  MOD_RES (5)..(5): Any amino acid
YIKIXA

SEQ ID NO: 3020 - protein, 6 aa, Artificial Sequence
  Description of Artificial Sequence: Synthetic peptide
  MOD_RES (5)..(5): Any amino acid
KSSTXE

SEQ ID NO: 3021 - protein, 6 aa, Artificial Sequence
  Description of Artificial Sequence: Synthetic peptide
  MOD_RES (5)..(5): Any amino acid
RSLFXE

SEQ ID NO: 3022 - protein, 6 aa, Artificial Sequence
  Description of Artificial Sequence: Synthetic peptide
  MOD_RES (5)..(5): Any amino acid
DAAGXT

SEQ ID NO: 3023 - protein, 6 aa, Artificial Sequence
  Description of Artificial Sequence: Synthetic peptide
  MOD_RES (5)..(5): Any amino acid
TGTGXT

SEQ ID NO: 3024 - protein, 6 aa, Artificial Sequence
  Description of Artificial Sequence: Synthetic peptide
  MOD_RES (5)..(5): Any amino acid
CKNGXT

SEQ ID NO: 3025 - protein, 6 aa, Artificial Sequence
  Description of Artificial Sequence: Synthetic peptide
  MOD_RES (5)..(5): Any amino acid
GTGKXF

SEQ ID NO: 3026 - protein, 6 aa, Artificial Sequence
  Description of Artificial Sequence: Synthetic peptide
  MOD_RES (5)..(5): Any amino acid
ACNGXS

SEQ ID NO: 3027 - protein, 6 aa, Artificial Sequence
  Description of Artificial Sequence: Synthetic peptide
  MOD_RES (5)..(5): Any amino acid
CLGNXC

SEQ ID NO: 3028 - protein, 6 aa, Artificial Sequence
  Description of Artificial Sequence: Synthetic peptide
  MOD_RES (5)..(5): Any amino acid
MELCXL

SEQ ID NO: 3029 - protein, 6 aa, Artificial Sequence
  Description of Artificial Sequence: Synthetic peptide
  MOD_RES (5)..(5): Any amino acid
SAGIXR

SEQ ID NO: 3030 - protein, 6 aa, Artificial Sequence
  Description of Artificial Sequence: Synthetic peptide
  MOD_RES (5)..(5): Any amino acid
QTGTXK

SEQ ID NO: 3031 - protein, 6 aa, Artificial Sequence
  Description of Artificial Sequence: Synthetic peptide
  MOD_RES (5)..(5): Any amino acid
NVACXN

SEQ ID NO: 3032 - protein, 6 aa, Artificial Sequence
  Description of Artificial Sequence: Synthetic peptide
  MOD_RES (5)..(5): Any amino acid
GVGKXN

SEQ ID NO: 3033 - protein, 6 aa, Artificial Sequence
  Description of Artificial Sequence: Synthetic peptide
  MOD_RES (5)..(5): Any amino acid
GQGIXS

SEQ ID NO: 3034 - protein, 6 aa, Artificial Sequence
  Description of Artificial Sequence: Synthetic peptide
  MOD_RES (5)..(5): Any amino acid
NWGRXV

SEQ ID NO: 3035 - protein, 6 aa, Artificial Sequence
  Description of Artificial Sequence: Synthetic peptide
  MOD_RES (5)..(5): Any amino acid
SGVGXS

SEQ ID NO: 3036 - protein, 6 aa, Artificial Sequence
  Description of Artificial Sequence: Synthetic peptide
  MOD_RES (5)..(5): Any amino acid
TQSPXS

SEQ ID NO: 3037 - protein, 6 aa, Artificial Sequence
  Description of Artificial Sequence: Synthetic peptide
  MOD_RES (5)..(5): Any amino acid
LDNAXK

SEQ ID NO: 3038 - protein, 6 aa, Artificial Sequence
  Description of Artificial Sequence: Synthetic peptide
  MOD_RES (5)..(5): Any amino acid
RIVNXT

SEQ ID NO: 3039 - protein, 6 aa, Artificial Sequence
  Description of Artificial Sequence: Synthetic peptide
  MOD_RES (5)..(5): Any amino acid
DGGTXK

SEQ ID NO: 3040 - protein, 6 aa, Artificial Sequence
  Description of Artificial Sequence: Synthetic peptide
  MOD_RES (5)..(5): Any amino acid
SSTGXT

SEQ ID NO: 3041 - protein, 6 aa, Artificial Sequence
  Description of Artificial Sequence: Synthetic peptide
  MOD_RES (5)..(5): Any amino acid
NVGKXS

SEQ ID NO: 3042 - protein, 6 aa, Artificial Sequence
  Description of Artificial Sequence: Synthetic peptide
  MOD_RES (5)..(5): Any amino acid
NYTPXL

SEQ ID NO: 3043 - protein, 6 aa, Artificial Sequence
  Description of Artificial Sequence: Synthetic peptide
  MOD_RES (5)..(5): Any amino acid
LGNIXR

SEQ ID NO: 3044 - protein, 6 aa, Artificial Sequence
  Description of Artificial Sequence: Synthetic peptide
  MOD_RES (5)..(5): Any amino acid
IVNYXP

SEQ ID NO: 3045 - protein, 6 aa, Artificial Sequence
  Description of Artificial Sequence: Synthetic peptide
  MOD_RES (5)..(5): Any amino acid
NQTPXR

SEQ ID NO: 3046 - protein, 6 aa, Artificial Sequence
  Description of Artificial Sequence: Synthetic peptide
  MOD_RES (5)..(5): Any amino acid
NSGKXT

SEQ ID NO: 3047 - protein, 6 aa, Artificial Sequence
  Description of Artificial Sequence: Synthetic peptide
  MOD_RES (5)..(5): Any amino acid
EYAPXG

SEQ ID NO: 3048 - protein, 6 aa, Artificial Sequence
  Description of Artificial Sequence: Synthetic peptide
  MOD_RES (5)..(5): Any amino acid
FTVAXN

SEQ ID NO: 3049 - protein, 6 aa, Artificial Sequence
  Description of Artificial Sequence: Synthetic peptide
  MOD_RES (5)..(5): Any amino acid
GTGKXT

SEQ ID NO: 3050 - protein, 6 aa, Artificial Sequence
  Description of Artificial Sequence: Synthetic peptide
  MOD_RES (5)..(5): Any amino acid
EFTFXD

SEQ ID NO: 3051 - protein, 6 aa, Artificial Sequence
  Description of Artificial Sequence: Synthetic peptide
  MOD_RES (5)..(5): Any amino acid
GGTGXT

SEQ ID NO: 3052 - protein, 6 aa, Artificial Sequence
  Description of Artificial Sequence: Synthetic peptide
  MOD_RES (5)..(5): Any amino acid
QGSGXT

SEQ ID NO: 3053 - protein, 6 aa, Artificial Sequence
  Description of Artificial Sequence: Synthetic peptide
  MOD_RES (5)..(5): Any amino acid
DSGVXK

SEQ ID NO: 3054 - protein, 6 aa, Artificial Sequence
  Description of Artificial Sequence: Synthetic peptide
  MOD_RES (5)..(5): Any amino acid
STVEXT

SEQ ID NO: 3055 - protein, 6 aa, Artificial Sequence
  Description of Artificial Sequence: Synthetic peptide
  MOD_RES (5)..(5): Any amino acid
VDHGXT

SEQ ID NO: 3056 - protein, 6 aa, Artificial Sequence
  Description of Artificial Sequence: Synthetic peptide
  MOD_RES (5)..(5): Any amino acid
SWGRXC

SEQ ID NO: 3057 - protein, 6 aa, Artificial Sequence
  Description of Artificial Sequence: Synthetic peptide
  MOD_RES (5)..(5): Any amino acid
LSGAXK

SEQ ID NO: 3058 - protein, 6 aa, Artificial Sequence
  Description of Artificial Sequence: Synthetic peptide
  MOD_RES (5)..(5): Any amino acid
KDYRXE

SEQ ID NO: 3059 - protein, 6 aa, Artificial Sequence
  Description of Artificial Sequence: Synthetic peptide
  MOD_RES (5)..(5): Any amino acid
KNVAXK

SEQ ID NO: 3060 - protein, 6 aa, Artificial Sequence
  Description of Artificial Sequence: Synthetic peptide
  MOD_RES (5)..(5): Any amino acid
SGSGXS

SEQ ID NO: 3061 - protein, 6 aa, Artificial Sequence
  Description of Artificial Sequence: Synthetic peptide
  MOD_RES (5)..(5): Any amino acid
PNGSXK

SEQ ID NO: 3062 - protein, 6 aa, Artificial Sequence
  Description of Artificial Sequence: Synthetic peptide
  MOD_RES (5)..(5): Any amino acid
EEGGXW

SEQ ID NO: 3063 - protein, 6 aa, Artificial Sequence
  Description of Artificial Sequence: Synthetic peptide
  MOD_RES (5)..(5): Any amino acid
KCKAXH

SEQ ID NO: 3064 - protein, 6 aa, Artificial Sequence
  Description of Artificial Sequence: Synthetic peptide
  MOD_RES (5)..(5): Any amino acid
NVGKXT

SEQ ID NO: 3065 - protein, 6 aa, Artificial Sequence
  Description of Artificial Sequence: Synthetic peptide
  MOD_RES (5)..(5): Any amino acid
LNVGXV

SEQ ID NO: 3066 - protein, 6 aa, Artificial Sequence
  Description of Artificial Sequence: Synthetic peptide
  MOD_RES (5)..(5): Any amino acid
GAGKXS

SEQ ID NO: 3067 - protein, 6 aa, Artificial Sequence
  Description of Artificial Sequence: Synthetic peptide
  MOD_RES (5)..(5): Any amino acid
DKEGXP

SEQ ID NO: 3068 - protein, 6 aa, Artificial Sequence
  Description of Artificial Sequence: Synthetic peptide
  MOD_RES (5)..(5): Any amino acid
TVAQXE

SEQ ID NO: 3069 - protein, 6 aa, Artificial Sequence
  Description of Artificial Sequence: Synthetic peptide
  MOD_RES (5)..(5): Any amino acid
VEFTXP

SEQ ID NO: 3070 - protein, 6 aa, Artificial Sequence
  Description of Artificial Sequence: Synthetic peptide
  MOD_RES (5)..(5): Any amino acid
GHGYXT

SEQ ID NO: 3071 - protein, 6 aa, Artificial Sequence
  Description of Artificial Sequence: Synthetic peptide
  MOD_RES (5)..(5): Any amino acid
GSTVXK

SEQ ID NO: 3072 - protein, 6 aa, Artificial Sequence
  Description of Artificial Sequence: Synthetic peptide
  MOD_RES (5)..(5): Any amino acid
SCKQXT

SEQ ID NO: 3073 - protein, 6 aa, Artificial Sequence
  Description of Artificial Sequence: Synthetic peptide
  MOD_RES (5)..(5): Any amino acid
RETGXS

SEQ ID NO: 3074 - protein, 6 aa, Artificial Sequence
  Description of Artificial Sequence: Synthetic peptide
  MOD_RES (5)..(5): Any amino acid
NGSGXS

SEQ ID NO: 3075 - protein, 6 aa, Artificial Sequence
  Description of Artificial Sequence: Synthetic peptide
  MOD_RES (5)..(5): Any amino acid
HHMEXP

SEQ ID NO: 3076 - protein, 6 aa, Artificial Sequence
  Description of Artificial Sequence: Synthetic peptide
  MOD_RES (5)..(5): Any amino acid
DHGKXT

SEQ ID NO: 3077 - protein, 6 aa, Artificial Sequence
  Description of Artificial Sequence: Synthetic peptide
  MOD_RES (5)..(5): Any amino acid
SPGAXR

SEQ ID NO: 3078 - protein, 6 aa, Artificial Sequence
  Description of Artificial Sequence: Synthetic peptide
  MOD_RES (5)..(5): Any amino acid
ACIAXE

SEQ ID NO: 3079 - protein, 6 aa, Artificial Sequence
  Description of Artificial Sequence: Synthetic peptide
  MOD_RES (5)..(5): Any amino acid
ELGPXR

SEQ ID NO: 3080 - protein, 6 aa, Artificial Sequence
  Description of Artificial Sequence: Synthetic peptide
  MOD_RES (5)..(5): Any amino acid
QHFKXL

SEQ ID NO: 3081 - protein, 6 aa, Artificial Sequence
  Description of Artificial Sequence: Synthetic peptide
  MOD_RES (5)..(5): Any amino acid
DLEAXG

SEQ ID NO: 3082 - protein, 6 aa, Artificial Sequence
  Description of Artificial Sequence: Synthetic peptide
  MOD_RES (5)..(5): Any amino acid
RSFKXF

SEQ ID NO: 3083 - protein, 6 aa, Artificial Sequence
  Description of Artificial Sequence: Synthetic peptide
  MOD_RES (5)..(5): Any amino acid
SVGKXS

SEQ ID NO: 3084 - protein, 6 aa, Artificial Sequence
  Description of Artificial Sequence: Synthetic peptide
  MOD_RES (5)..(5): Any amino acid
IYRDXL

SEQ ID NO: 3085 - protein, 6 aa, Artificial Sequence
  Description of Artificial Sequence: Synthetic peptide
  MOD_RES (5)..(5): Any amino acid
PNVGXS

SEQ ID NO: 3086 - protein, 6 aa, Artificial Sequence
  Description of Artificial Sequence: Synthetic peptide
  MOD_RES (5)..(5): Any amino acid
GTGKXC

SEQ ID NO: 3087 - protein, 6 aa, Artificial Sequence
  Description of Artificial Sequence: Synthetic peptide
  MOD_RES (5)..(5): Any amino acid
GPLRXF

SEQ ID NO: 3088 - protein, 6 aa, Artificial Sequence
  Description of Artificial Sequence: Synthetic peptide
STKVDK

SEQ ID NO: 3089 - protein, 6 aa, Artificial Sequence
  Description of Artificial Sequence: Synthetic peptide
TKVDKK

SEQ ID NO: 3090 - protein, 6 aa, Artificial Sequence
  Description of Artificial Sequence: Synthetic peptide
SSTKVD

SEQ ID NO: 3091 - protein, 6 aa, Artificial Sequence
  Description of Artificial Sequence: Synthetic peptide
GSGKST

SEQ ID NO: 3092 - protein, 6 aa, Artificial Sequence
  Description of Artificial Sequence: Synthetic peptide
TQTGKT

SEQ ID NO: 3093 - protein, 6 aa, Artificial Sequence
  Description of Artificial Sequence: Synthetic peptide
SAGIGR

SEQ ID NO: 3094 - protein, 6 aa, Artificial Sequence
  Description of Artificial Sequence: Synthetic peptide
VACKNG

SEQ ID NO: 3095 - protein, 6 aa, Artificial Sequence
  Description of Artificial Sequence: Synthetic peptide
YASGRT

SEQ ID NO: 3096 - protein, 6 aa, Artificial Sequence
  Description of Artificial Sequence: Synthetic peptide
SAGVGR

SEQ ID NO: 3097 - protein, 6 aa, Artificial Sequence
  Description of Artificial Sequence: Synthetic peptide
DNAGKT

SEQ ID NO: 3098 - protein, 6 aa, Artificial Sequence
  Description of Artificial Sequence: Synthetic peptide
NAGKTT

SEQ ID NO: 3099 - protein, 6 aa, Artificial Sequence
  Description of Artificial Sequence: Synthetic peptide
CSAGIG

SEQ ID NO: 3100 - protein, 6 aa, Artificial Sequence
  Description of Artificial Sequence: Synthetic peptide
GVGKSA

SEQ ID NO: 3101 - protein, 6 aa, Artificial Sequence
  Description of Artificial Sequence: Synthetic peptide
TGTGKT

SEQ ID NO: 3102 - protein, 6 aa, Artificial Sequence
  Description of Artificial Sequence: Synthetic peptide
AAGKTT

SEQ ID NO: 3103 - protein, 6 aa, Artificial Sequence
  Description of Artificial Sequence: Synthetic peptide
DAAGKT

SEQ ID NO: 3104 - protein, 6 aa, Artificial Sequence
  Description of Artificial Sequence: Synthetic peptide
CLGNIC

SEQ ID NO: 3105 - protein, 6 aa, Artificial Sequence
  Description of Artificial Sequence: Synthetic peptide
GTDVVG

SEQ ID NO: 3106 - protein, 6 aa, Artificial Sequence
  Description of Artificial Sequence: Synthetic peptide
PTWNIG

SEQ ID NO: 3107 - protein, 6 aa, Artificial Sequence
  Description of Artificial Sequence: Synthetic peptide
CSAGVG

SEQ ID NO: 3108 - protein, 6 aa, Artificial Sequence
  Description of Artificial Sequence: Synthetic peptide
HIASVA

SEQ ID NO: 3109 - protein, 6 aa, Artificial Sequence
  Description of Artificial Sequence: Synthetic peptide
ALASTA

SEQ ID NO: 3110 - protein, 6 aa, Artificial Sequence
  Description of Artificial Sequence: Synthetic peptide
GTMKPV

SEQ ID NO: 3111 - protein, 6 aa, Artificial Sequence
  Description of Artificial Sequence: Synthetic peptide
AEKGLV

SEQ ID NO: 3112 - protein, 6 aa, Artificial Sequence
  Description of Artificial Sequence: Synthetic peptide
ANALAS

SEQ ID NO: 3113 - protein, 6 aa, Artificial Sequence
  Description of Artificial Sequence: Synthetic peptide
YIKIHA

SEQ ID NO: 3114 - protein, 6 aa, Artificial Sequence
  Description of Artificial Sequence: Synthetic peptide
RITTLD

SEQ ID NO: 3115 - protein, 6 aa, Artificial Sequence
  Description of Artificial Sequence: Synthetic peptide
NALAST

SEQ ID NO: 3116 - protein, 6 aa, Artificial Sequence
  Description of Artificial Sequence: Synthetic peptide
RSLFLE

SEQ ID NO: 3117 - protein, 6 aa, Artificial Sequence
  Description of Artificial Sequence: Synthetic peptide
GYRDNG

SEQ ID NO: 3118 - protein, 6 aa, Artificial Sequence
  Description of Artificial Sequence: Synthetic peptide
GSGKTT

SEQ ID NO: 3119 - protein, 6 aa, Artificial Sequence
  Description of Artificial Sequence: Synthetic peptide
SAGIGR

SEQ ID NO: 3120 - protein, 6 aa, Artificial Sequence
  Description of Artificial Sequence: Synthetic peptide
DGGTGK

SEQ ID NO: 3121 - protein, 6 aa, Artificial Sequence
  Description of Artificial Sequence: Synthetic peptide
LDNAGK

SEQ ID NO: 3122 - protein, 6 aa, Artificial Sequence
  Description of Artificial Sequence: Synthetic peptide
GTGKTF

SEQ ID NO: 3123 - protein, 6 aa, Artificial Sequence
  Description of Artificial Sequence: Synthetic peptide
NTKVDK

SEQ ID NO: 3124 - protein, 6 aa, Artificial Sequence
  Description of Artificial Sequence: Synthetic peptide
SGVGKS

SEQ ID NO: 3125 - protein, 6 aa, Artificial Sequence
  Description of Artificial Sequence: Synthetic peptide
GAGKTT

SEQ ID NO: 3126 - protein, 6 aa, Artificial Sequence
  Description of Artificial Sequence: Synthetic peptide
GVGKSS

SEQ ID NO: 3127 - protein, 6 aa, Artificial Sequence
  Description of Artificial Sequence: Synthetic peptide
ACNGDS

SEQ ID NO: 3128 - protein, 6 aa, Artificial Sequence
  Description of Artificial Sequence: Synthetic peptide
IVNYTP

SEQ ID NO: 3129 - protein, 6 aa, Artificial Sequence
  Description of Artificial Sequence: Synthetic peptide
MELCTL

SEQ ID NO: 3130 - protein, 6 aa, Artificial Sequence
  Description of Artificial Sequence: Synthetic peptide
CSAGIG

SEQ ID NO: 3131 - protein, 6 aa, Artificial Sequence
  Description of Artificial Sequence: Synthetic peptide
LGNICR

SEQ ID NO: 3132 - protein, 6 aa, Artificial Sequence
  Description of Artificial Sequence: Synthetic peptide
QTGTGK

SEQ ID NO: 3133 - protein, 6 aa, Artificial Sequence
  Description of Artificial Sequence: Synthetic peptide
GVGKSN

SEQ ID NO: 3134 - protein, 6 aa, Artificial Sequence
  Description of Artificial Sequence: Synthetic peptide
GQGIMS

SEQ ID NO: 3135 - protein, 6 aa, Artificial Sequence
  Description of Artificial Sequence: Synthetic peptide
SSTGNT

SEQ ID NO: 3136 - protein, 6 aa, Artificial Sequence
  Description of Artificial Sequence: Synthetic peptide
NVACKN

SEQ ID NO: 3137 - protein, 6 aa, Artificial Sequence
  Description of Artificial Sequence: Synthetic peptide
RIVNYT

SEQ ID NO: 3138 - protein, 6 aa, Artificial Sequence
  Description of Artificial Sequence: Synthetic peptide
DSGVGK

SEQ ID NO: 3139 - protein, 6 aa, Artificial Sequence
  Description of Artificial Sequence: Synthetic peptide
QGSGKT

SEQ ID NO: 3140 - protein, 6 aa, Artificial Sequence
  Description of Artificial Sequence: Synthetic peptide
PNGSGK

SEQ ID NO: 3141 - protein, 6 aa, Artificial Sequence
  Description of Artificial Sequence: Synthetic peptide
GGTGKT

SEQ ID NO: 3142 - protein, 6 aa, Artificial Sequence
  Description of Artificial Sequence: Synthetic peptide
KNVACK

SEQ ID NO: 3143 - protein, 6 aa, Artificial Sequence
  Description of Artificial Sequence: Synthetic peptide
GAGKTS

SEQ ID NO: 3144 - protein, 6 aa, Artificial Sequence
  Description of Artificial Sequence: Synthetic peptide
NQTPNR

SEQ ID NO: 3145 - protein, 6 aa, Artificial Sequence
  Description of Artificial Sequence: Synthetic peptide
VDHGKT

SEQ ID NO: 3146 - protein, 6 aa, Artificial Sequence
  Description of Artificial Sequence: Synthetic peptide
QALSGL

SEQ ID NO: 3147 - protein, 6 aa, Artificial Sequence
  Description of Artificial Sequence: Synthetic peptide
VSWGRG

SEQ ID NO: 3148 - protein, 6 aa, Artificial Sequence
  Description of Artificial Sequence: Synthetic peptide
SGSGKS

SEQ ID NO: 3149 - protein, 6 aa, Artificial Sequence
  Description of Artificial Sequence: Synthetic peptide
NSGKTT

SEQ ID NO: 3150 - protein, 6 aa, Artificial Sequence
  Description of Artificial Sequence: Synthetic peptide
GVGKTS

SEQ ID NO: 3151 - protein, 6 aa, Artificial Sequence
  Description of Artificial Sequence: Synthetic peptide
DHGKTT

SEQ ID NO: 3152 - protein, 6 aa, Artificial Sequence
  Description of Artificial Sequence: Synthetic peptide
LNVGMV

SEQ ID NO: 3153 - protein, 6 aa, Artificial Sequence
  Description of Artificial Sequence: Synthetic peptide
QCGSCW

SEQ ID NO: 3154 - protein, 6 aa, Artificial Sequence
  Description of Artificial Sequence: Synthetic peptide
PSGSGK

SEQ ID NO: 3155 - protein, 6 aa, Artificial Sequence
  Description of Artificial Sequence: Synthetic peptide
GGVGKS

SEQ ID NO: 3156 - protein, 6 aa, Artificial Sequence
  Description of Artificial Sequence: Synthetic peptide
GTGKTT

SEQ ID NO: 3157 - protein, 6 aa, Artificial Sequence
  Description of Artificial Sequence: Synthetic peptide
GSTVEK

SEQ ID NO: 3158 - protein, 6 aa, Artificial Sequence
  Description of Artificial Sequence: Synthetic peptide
LSGAGK

SEQ ID NO: 3159 - protein, 6 aa, Artificial Sequence
  Description of Artificial Sequence: Synthetic peptide
EFTFPD

SEQ ID NO: 3160 - protein, 6 aa, Artificial Sequence
  Description of Artificial Sequence: Synthetic peptide
VEFTFP

SEQ ID NO: 3161 - protein, 6 aa, Artificial Sequence
  Description of Artificial Sequence: Synthetic peptide
GLGFSI

SEQ ID NO: 3162 - protein, 6 aa, Artificial Sequence
  Description of Artificial Sequence: Synthetic peptide
NGSGKS

SEQ ID NO: 3163 - protein, 6 aa, Artificial Sequence
  Description of Artificial Sequence: Synthetic peptide
SWGRGC

SEQ ID NO: 3164 - protein, 6 aa, Artificial Sequence
  Description of Artificial Sequence: Synthetic peptide
QGQGIM

SEQ ID NO: 3165 - protein, 6 aa, Artificial Sequence
  Description of Artificial Sequence: Synthetic peptide
KCKACH

SEQ ID NO: 3166 - protein, 6 aa, Artificial Sequence
  Description of Artificial Sequence: Synthetic peptide
AAGKST

SEQ ID NO: 3167 - protein, 6 aa, Artificial Sequence
  Description of Artificial Sequence: Synthetic peptide
NVGKST

SEQ ID NO: 3168 - protein, 6 aa, Artificial Sequence
  Description of Artificial Sequence: Synthetic peptide
PNVGKS

SEQ ID NO: 3169 - protein, 6 aa, Artificial Sequence
  Description of Artificial Sequence: Synthetic peptide
WGHGYA

SEQ ID NO: 3170 - protein, 6 aa, Artificial Sequence
  Description of Artificial Sequence: Synthetic peptide
GHGYAT

SEQ ID NO: 3171 - protein, 6 aa, Artificial Sequence
  Description of Artificial Sequence: Synthetic peptide
RVEFTF

SEQ ID NO: 3172 - protein, 6 aa, Artificial Sequence
  Description of Artificial Sequence: Synthetic peptide
ELGPLR

SEQ ID NO: 3173 - protein, 6 aa, Artificial Sequence
  Description of Artificial Sequence: Synthetic peptide
GTGKSC

SEQ ID NO: 3174 - protein, 6 aa, Artificial Sequence
  Description of Artificial Sequence: Synthetic peptide
STGAGK

SEQ ID NO: 3175 - protein, 6 aa, Artificial Sequence
  Description of Artificial Sequence: Synthetic peptide
QRRGLG

SEQ ID NO: 3176 - protein, 6 aa, Artificial Sequence
  Description of Artificial Sequence: Synthetic peptide
INGNSA

SEQ ID NO: 3177 - protein, 6 aa, Artificial Sequence
  Description of Artificial Sequence: Synthetic peptide
STVEKT

SEQ ID NO: 3178 - protein, 6 aa, Artificial Sequence
  Description of Artificial Sequence: Synthetic peptide
TLKGET

SEQ ID NO: 3179 - protein, 6 aa, Artificial Sequence
  Description of Artificial Sequence: Synthetic peptide
PLRSFK

SEQ ID NO: 3180 - protein, 6 aa, Artificial Sequence
  Description of Artificial Sequence: Synthetic peptide
GLTDWK

SEQ ID NO: 3181 - protein, 6 aa, Artificial Sequence
  Description of Artificial Sequence: Synthetic peptide
PGSGKG

SEQ ID NO: 3182 - protein, 6 aa, Artificial Sequence
  Description of Artificial Sequence: Synthetic peptide
GPLRSF

SEQ ID NO: 3183 - protein, 6 aa, Artificial Sequence
  Description of Artificial Sequence: Synthetic peptide
SPSSLS

SEQ ID NO: 3184 - protein, 6 aa, Artificial Sequence
  Description of Artificial Sequence: Synthetic peptide
LGPLRS

SEQ ID NO: 3185 - protein, 6 aa, Artificial Sequence
  Description of Artificial Sequence: Synthetic peptide
PSSLSA

SEQ ID NO: 3186 - protein, 6 aa, Artificial Sequence
  Description of Artificial Sequence: Synthetic peptide
SVGKTS

SEQ ID NO: 3187 - protein, 6 aa, Artificial Sequence
  Description of Artificial Sequence: Synthetic peptide
  MOD_RES (2)..(2): Any amino acid
  MOD_RES (5)..(5): Any amino acid
FXGHXA

SEQ ID NO: 3188 - protein, 6 aa, Artificial Sequence
  Description of Artificial Sequence: Synthetic peptide
  MOD_RES (5)..(5): Any amino acid
FPGHXA

SEQ ID NO: 3189 - protein, 6 aa, Artificial Sequence
  Description of Artificial Sequence: Synthetic peptide
  MOD_RES (3)..(3): Any amino acid
  MOD_RES (5)..(5): Any amino acid
FPXHXA

SEQ ID NO: 3190 - protein, 6 aa, Artificial Sequence
  Description of Artificial Sequence: Synthetic peptide
  MOD_RES (2)..(4): Any amino acid
EXXXMD

SEQ ID NO: 3191 - protein, 4 aa, Artificial Sequence
  Description of Artificial Sequence: Synthetic peptide
FPGH

SEQ ID NO: 3192 - protein, 6 aa, Artificial Sequence
  Description of Artificial Sequence: Synthetic peptide
  MOD_RES (2)..(3): Any amino acid
  MOD_RES (5)..(5): Any amino acid
FXXHXA

SEQ ID NO: 3193 - protein, 6 aa, Artificial Sequence
  Description of Artificial Sequence: Synthetic peptide
  MOD_RES (3)..(4): Any amino acid
ERXXMD

SEQ ID NO: 3194 - protein, 5 aa, Artificial Sequence
  Description of Artificial Sequence: Synthetic peptide
  MOD_RES (3)..(3): Any amino acid
LGXSI

SEQ ID NO: 3195 - protein, 4 aa, Artificial Sequence
  Description of Artificial Sequence: Synthetic peptide
  MOD_RES (2)..(2): Any amino acid
FXGH

SEQ ID NO: 3196 - protein, 6 aa, Artificial Sequence
  Description of Artificial Sequence: Synthetic peptide
  MOD_RES (2)..(2): Any amino acid
  MOD_RES (4)..(4): Any amino acid
PXHXAL

SEQ ID NO: 3197 - protein, 6 aa, Artificial Sequence
  Description of Artificial Sequence: Synthetic peptide
  MOD_RES (4)..(5): Any amino acid
PGHXXL

SEQ ID NO: 3198 - protein, 6 aa, Artificial Sequence
  Description of Artificial Sequence: Synthetic peptide
  MOD_RES (2)..(3): Any amino acid
RXXMDS

SEQ ID NO: 3199 - protein, 5 aa, Artificial Sequence
  Description of Artificial Sequence: Synthetic peptide
  MOD_RES (2)..(3): Any amino acid
RXXMD

SEQ ID NO: 3200 - protein, 6 aa, Artificial Sequence
  Description of Artificial Sequence: Synthetic peptide
  MOD_RES (2)..(3): Any amino acid
KXXFTV

SEQ ID NO: 3201 - protein, 6 aa, Artificial Sequence
  Description of Artificial Sequence: Synthetic peptide
  MOD_RES (2)..(3): Any amino acid
  MOD_RES (5)..(5): Any amino acid
KXXFXV

SEQ ID NO: 3202 - protein, 6 aa, Artificial Sequence
  Description of Artificial Sequence: Synthetic peptide
  MOD_RES (4)..(5): Any amino acid
FPGXXA

SEQ ID NO: 3203 - protein, 6 aa, Artificial Sequence
  Description of Artificial Sequence: Synthetic peptide
  MOD_RES (4)..(5): Any amino acid
NYTXXL

SEQ ID NO: 3204 - protein, 6 aa, Artificial Sequence
  Description of Artificial Sequence: Synthetic peptide
  MOD_RES (4)..(5): Any amino acid
VACXXG

SEQ ID NO: 3205 - protein, 6 aa, Artificial Sequence
  Description of Artificial Sequence: Synthetic peptide
  MOD_RES (2)..(2): Any amino acid
  MOD_RES (4)..(5): Any amino acid
PXHXXL

SEQ ID NO: 3206 - protein, 4 aa, Artificial Sequence
  Description of Artificial Sequence: Synthetic peptide
  MOD_RES (3)..(3): Any amino acid
FPXH

SEQ ID NO: 3207 - protein, 6 aa, Artificial Sequence
  Description of Artificial Sequence: Synthetic peptide
  MOD_RES (2)..(3): Any amino acid
LXXNVM

SEQ ID NO: 3208 - protein, 6 aa, Artificial Sequence
  Description of Artificial Sequence: Synthetic peptide
  MOD_RES (5)..(5): Any amino acid
VACKXG

SEQ ID NO: 3209 - protein, 6 aa, Artificial Sequence
  Description of Artificial Sequence: Synthetic peptide
  MOD_RES (5)..(5): Any amino acid
NYTPXL

SEQ ID NO: 3210 - protein, 6 aa, Artificial Sequence
  Description of Artificial Sequence: Synthetic peptide
  MOD_RES (3)..(3): Any amino acid
  MOD_RES (5)..(5): Any amino acid
CKXGXT

SEQ ID NO: 3211 - protein, 6 aa, Artificial Sequence
  Description of Artificial Sequence: Synthetic peptide
  MOD_RES (2)..(2): Any amino acid
  MOD_RES (4)..(5): Any amino acid
VXCXXG

SEQ ID NO: 3212 - protein, 5 aa, Artificial Sequence
  Description of Artificial Sequence: Synthetic peptide
  MOD_RES (4)..(4): Any amino acid
PGHXA

SEQ ID NO: 3213 - protein, 6 aa, Artificial Sequence
  Description of Artificial Sequence: Synthetic peptide
  MOD_RES (4)..(4): Any amino acid
VACXNG

SEQ ID NO: 3214 - protein, 6 aa, Artificial Sequence
  Description of Artificial Sequence: Synthetic peptide
  MOD_RES (2)..(2): Any amino acid
  MOD_RES (5)..(5): Any amino acid
VXCKXG

SEQ ID NO: 3215 - protein, 4 aa, Artificial Sequence
  Description of Artificial Sequence: Synthetic peptide
MDSS

SEQ ID NO: 3216 - protein, 6 aa, Artificial Sequence
  Description of Artificial Sequence: Synthetic peptide
  MOD_RES (2)..(2): Any amino acid
  MOD_RES (4)..(4): Any amino acid
VXCXNG

SEQ ID NO: 3217 - protein, 6 aa, Artificial Sequence
  Description of Artificial Sequence: Synthetic peptide
VACKNG

SEQ ID NO: 3218 - protein, 6 aa, Artificial Sequence
  Description of Artificial Sequence: Synthetic peptide
  MOD_RES (2)..(2): Any amino acid
  MOD_RES (5)..(5): Any amino acid
NXTPXL

SEQ ID NO: 3219 - protein, 5 aa, Artificial Sequence
  Description of Artificial Sequence: Synthetic peptide
  MOD_RES (4)..(4): Any amino acid
GFTXS

SEQ ID NO: 3220 - protein, 6 aa, Artificial Sequence
  Description of Artificial Sequence: Synthetic peptide
  MOD_RES (5)..(5): Any amino acid
IVNYXP

SEQ ID NO: 3221 - protein, 5 aa, Artificial Sequence
  Description of Artificial Sequence: Synthetic peptide
  MOD_RES (3)..(3): Any amino acid
GFXNS

SEQ ID NO: 3222 - protein, 5 aa, Artificial Sequence
  Description of Artificial Sequence: Synthetic peptide
GFTNS

SEQ ID NO: 3223 - protein, 6 aa, Artificial Sequence
  Description of Artificial Sequence: Synthetic peptide
  MOD_RES (2)..(2): Any amino acid
VXCKNG

SEQ ID NO: 3224 - protein, 6 aa, Artificial Sequence
  Description of Artificial Sequence: Synthetic peptide
  MOD_RES (3)..(3): Any amino acid
  MOD_RES (5)..(5): Any amino acid
IVXYXP

SEQ ID NO: 3225 - protein, 6 aa, Artificial Sequence
  Description of Artificial Sequence: Synthetic peptide
  MOD_RES (4)..(5): Any amino acid
IVNXXP

SEQ ID NO: 3226 - protein, 6 aa, Artificial Sequence
  Description of Artificial Sequence: Synthetic peptide
  MOD_RES (2)..(3): Any amino acid
  MOD_RES (5)..(5): Any amino acid
LXXNXM

SEQ ID NO: 3227 - protein, 5 aa, Artificial Sequence
  Description of Artificial Sequence: Synthetic peptide
  MOD_RES (3)..(4): Any amino acid
GHXXL

SEQ ID NO: 3228 - protein, 6 aa, Artificial Sequence
  Description of Artificial Sequence: Synthetic peptide
  MOD_RES (2)..(4): Any amino acid
LXXXVM

SEQ ID NO: 3229 - protein, 5 aa, Artificial Sequence
  Description of Artificial Sequence: Synthetic peptide
  MOD_RES (4)..(4): Any amino acid
ACKXG

SEQ ID NO: 3230 - protein, 5 aa, Artificial Sequence
  Description of Artificial Sequence: Synthetic peptide
  MOD_RES (2)..(2): Any amino acid
GXTNS

SEQ ID NO: 3231 - protein, 6 aa, Artificial Sequence
  Description of Artificial Sequence: Synthetic peptide
  MOD_RES (3)..(4): Any amino acid
RIXXNL

SEQ ID NO: 3232 - protein, 5 aa, Artificial Sequence
  Description of Artificial Sequence: Synthetic peptide
  MOD_RES (2)..(2): Any amino acid
NXGYH

SEQ ID NO: 3233 - protein, 5 aa, Artificial Sequence
  Description of Artificial Sequence: Synthetic peptide
  MOD_RES (4)..(4): Any amino acid
VACXN

SEQ ID NO: 3234 - protein, 4 aa, Artificial Sequence
  Description of Artificial Sequence: Synthetic peptide
PSVY

SEQ ID NO: 3235 - protein, 6 aa, Artificial Sequence
  Description of Artificial Sequence: Synthetic peptide
  MOD_RES (2)..(2): Any amino acid
  MOD_RES (5)..(5): Any amino acid
CXNGXT

SEQ ID NO: 3236 - protein, 6 aa, Artificial Sequence
  Description of Artificial Sequence: Synthetic peptide
  MOD_RES (5)..(5): Any amino acid
CKNGXT

SEQ ID NO: 3237 - protein, 6 aa, Artificial Sequence
  Description of Artificial Sequence: Synthetic peptide
  MOD_RES (3)..(5): Any amino acid
FTXXXN

SEQ ID NO: 3238 - protein, 6 aa, Artificial Sequence
  Description of Artificial Sequence: Synthetic peptide
  MOD_RES (2)..(2): Any amino acid
  MOD_RES (4)..(4): Any amino acid
NXQXQF

SEQ ID NO: 3239 - protein, 5 aa, Artificial Sequence
  Description of Artificial Sequence: Synthetic peptide
  MOD_RES (3)..(3): Any amino acid
QFXTN

SEQ ID NO: 3240 - protein, 5 aa, Artificial Sequence
  Description of Artificial Sequence: Synthetic peptide
  MOD_RES (2)..(3): Any amino acid
NXXYH

SEQ ID NO: 3241 - protein, 6 aa, Artificial Sequence
  Description of Artificial Sequence: Synthetic peptide
  MOD_RES (3)..(5): Any amino acid
ERXXXD

SEQ ID NO: 3242 - protein, 6 aa, Artificial Sequence
  Description of Artificial Sequence: Synthetic peptide
  MOD_RES (2)..(3): Any amino acid
LXXKDY

SEQ ID NO: 3243 - protein, 5 aa, Artificial Sequence
  Description of Artificial Sequence: Synthetic peptide
QFNTN

SEQ ID NO: 3244 - protein, 5 aa, Artificial Sequence
  Description of Artificial Sequence: Synthetic peptide
NVACK

SEQ ID NO: 3245 - protein, 6 aa, Artificial Sequence
  Description of Artificial Sequence: Synthetic peptide
  MOD_RES (3)..(4): Any amino acid
PGXXAL

SEQ ID NO: 3246 - protein, 5 aa, Artificial Sequence
  Description of Artificial Sequence: Synthetic peptide
  MOD_RES (2)..(2): Any amino acid
VXCKN

SEQ ID NO: 3247 - protein, 6 aa, Artificial Sequence
  Description of Artificial Sequence: Synthetic peptide
  MOD_RES (5)..(5): Any amino acid
NVACXN

SEQ ID NO: 3248 - protein, 6 aa, Artificial Sequence
  Description of Artificial Sequence: Synthetic peptide
  MOD_RES (4)..(5): Any amino acid
CKNXXT

SEQ ID NO: 3249 - protein, 6 aa, Artificial Sequence
  Description of Artificial Sequence: Synthetic peptide
  MOD_RES (2)..(2): Any amino acid
NXTPNR

SEQ ID NO: 3250 - protein, 6 aa, Artificial Sequence
  Description of Artificial Sequence: Synthetic peptide
  MOD_RES (3)..(3): Any amino acid
  MOD_RES (5)..(5): Any amino acid
VAXKXG

SEQ ID NO: 3251 - protein, 5 aa, Artificial Sequence
  Description of Artificial Sequence: Synthetic peptide
VACKN

SEQ ID NO: 3252 - protein, 6 aa, Artificial Sequence
  Description of Artificial Sequence: Synthetic peptide
  MOD_RES (4)..(5): Any amino acid
GYSXXN

SEQ ID NO: 3253 - protein, 6 aa, Artificial Sequence
  Description of Artificial Sequence: Synthetic peptide
  MOD_RES (3)..(5): Any amino acid
GFXXXG

SEQ ID NO: 3254 - protein, 6 aa, Artificial Sequence
  Description of Artificial Sequence: Synthetic peptide
NQTPNR

SEQ ID NO: 3255 - protein, 5 aa, Artificial Sequence
  Description of Artificial Sequence: Synthetic peptide
  MOD_RES (3)..(3): Any amino acid
YSXMS

SEQ ID NO: 3256 - protein, 6 aa, Artificial Sequence
  Description of Artificial Sequence: Synthetic peptide
  MOD_RES (2)..(2): Any amino acid
  MOD_RES (5)..(5): Any amino acid
KXYRXE

SEQ ID NO: 3257 - protein, 5 aa, Artificial Sequence
  Description of Artificial Sequence: Synthetic peptide
  MOD_RES (2)..(2): Any amino acid
NXACK

SEQ ID NO: 3258 - protein, 6 aa, Artificial Sequence
  Description of Artificial Sequence: Synthetic peptide
  MOD_RES (4)..(4): Any amino acid
NQTXNR

SEQ ID NO: 3259 - protein, 5 aa, Artificial Sequence
  Description of Artificial Sequence: Synthetic peptide
  MOD_RES (3)..(3): Any amino acid
NVXCK

SEQ ID NO: 3260 - protein, 5 aa, Artificial Sequence
  Description of Artificial Sequence: Synthetic peptide
  MOD_RES (4)..(4): Any amino acid
YTPXL

SEQ ID NO: 3261 - protein, 4 aa, Artificial Sequence
  Description of Artificial Sequence: Synthetic peptide
NVAC

SEQ ID NO: 3262 - protein, 6 aa, Artificial Sequence
  Description of Artificial Sequence: Synthetic peptide
NVACKN

SEQ ID NO: 3263 - protein, 5 aa, Artificial Sequence
  Description of Artificial Sequence: Synthetic peptide
  MOD_RES (4)..(4): Any amino acid
QFNXN

SEQ ID NO: 3264 - protein, 4 aa, Artificial Sequence
  Description of Artificial Sequence: Synthetic peptide
FTVA

SEQ ID NO: 3265 - protein, 5 aa, Artificial Sequence
  Description of Artificial Sequence: Synthetic peptide
  MOD_RES (2)..(2): Any amino acid
  MOD_RES (4)..(4): Any amino acid
VXCXN

SEQ ID NO: 3266 - protein, 5 aa, Artificial Sequence
  Description of Artificial Sequence: Synthetic peptide
YSTMS

SEQ ID NO: 3267 - protein, 5 aa, Artificial Sequence
  Description of Artificial Sequence: Synthetic peptide
PPGPP

SEQ ID NO: 3268 - protein, 6 aa, Artificial Sequence
  Description of Artificial Sequence: Synthetic peptide
  MOD_RES (2)..(2): Any amino acid
  MOD_RES (4)..(4): Any amino acid
NXTXNR

SEQ ID NO: 3269 - protein, 5 aa, Artificial Sequence
  Description of Artificial Sequence: Synthetic peptide
  MOD_RES (3)..(4): Any amino acid
ERXXM

SEQ ID NO: 3270 - protein, 4 aa, Artificial Sequence
  Description of Artificial Sequence: Synthetic peptide
  MOD_RES (2)..(2): Any amino acid
GXGF

SEQ ID NO: 3271 - protein, 6 aa, Artificial Sequence
  Description of Artificial Sequence: Synthetic peptide
  MOD_RES (3)..(3): Any amino acid
  MOD_RES (5)..(5): Any amino acid
NVXCXN

SEQ ID NO: 3272 - protein, 5 aa, Artificial Sequence
  Description of Artificial Sequence: Synthetic peptide
  MOD_RES (2)..(2): Any amino acid
YXTMS

SEQ ID NO: 3273 - protein, 5 aa, Artificial Sequence
  Description of Artificial Sequence: Synthetic peptide
  MOD_RES (3)..(4): Any amino acid
GFXXS

SEQ ID NO: 3274 - protein, 4 aa, Artificial Sequence
  Description of Artificial Sequence: Synthetic peptide
VACK

SEQ ID NO: 3275 - protein, 4 aa, Artificial Sequence
  Description of Artificial Sequence: Synthetic peptide
  MOD_RES (2)..(2): Any amino acid
VXCK

SEQ ID NO: 3276 - protein, 4 aa, Artificial Sequence
  Description of Artificial Sequence: Synthetic peptide
  MOD_RES (2)..(2): Any amino acid
NXAC

SEQ ID NO: 3277 - protein, 6 aa, Artificial Sequence
  Description of Artificial Sequence: Synthetic peptide
  MOD_RES (2)..(2): Any amino acid
  MOD_RES (5)..(5): Any amino acid
NXTPXR

SEQ ID NO: 3278 - protein, 4 aa, Artificial Sequence
  Description of Artificial Sequence: Synthetic peptide
  MOD_RES (2)..(2): Any amino acid
SXMS

SEQ ID NO: 3279 - protein, 4 aa, Artificial Sequence
  Description of Artificial Sequence: Synthetic peptide
STMS

SEQ ID NO: 3280 - protein, 4 aa, Artificial Sequence
  Description of Artificial Sequence: Synthetic peptide
  MOD_RES (3)..(3): Any amino acid
NVXC

SEQ ID NO: 3281 - protein, 6 aa, Artificial Sequence
  Description of Artificial Sequence: Synthetic peptide
  MOD_RES (2)..(2): Any amino acid
  MOD_RES (5)..(5): Any amino acid
NXACXN

SEQ ID NO: 3282 - protein, 4 aa, Artificial Sequence
  Description of Artificial Sequence: Synthetic peptide
  MOD_RES (3)..(3): Any amino acid
QFXT

SEQ ID NO: 3283 - protein, 6 aa, Artificial Sequence
  Description of Artificial Sequence: Synthetic peptide
  MOD_RES (4)..(5): Any amino acid
TVAXXE

SEQ ID NO: 3284 - protein, 6 aa, Artificial Sequence
  Description of Artificial Sequence: Synthetic peptide
  MOD_RES (5)..(5): Any amino acid
NQTPXR

SEQ ID NO: 3285 - protein, 5 aa, Artificial Sequence
  Description of Artificial Sequence: Synthetic peptide
  MOD_RES (3)..(3): Any amino acid
TMXRI

SEQ ID NO: 3286 - protein, 5 aa, Artificial Sequence
  Description of Artificial Sequence: Synthetic peptide
  MOD_RES (2)..(3): Any amino acid
YXXMS

SEQ ID NO: 3287 - protein, 5 aa, Artificial Sequence
  Description of Artificial Sequence: Synthetic peptide
  MOD_RES (3)..(3): Any amino acid
ACXNG

SEQ ID NO: 3288 - protein, 5 aa, Artificial Sequence
  Description of Artificial Sequence: Synthetic peptide
ACKNG

SEQ ID NO: 3289 - protein, 6 aa, Artificial Sequence
  Description of Artificial Sequence: Synthetic peptide
  MOD_RES (2)..(2): Any amino acid
  MOD_RES (4)..(4): Any amino acid
KXVXCK

SEQ ID NO: 3290 - protein, 5 aa, Artificial Sequence
  Description of Artificial Sequence: Synthetic peptide
  MOD_RES (2)..(2): Any amino acid
KXVAC

SEQ ID NO: 3291 - protein, 6 aa, Artificial Sequence
  Description of Artificial Sequence: Synthetic peptide
KNVACK

SEQ ID NO: 3292 - protein, 6 aa, Artificial Sequence
  Description of Artificial Sequence: Synthetic peptide
  MOD_RES (2)..(3): Any amino acid
  MOD_RES (5)..(5): Any amino acid
RXXMXS

SEQ ID NO: 3293 - protein, 6 aa, Artificial Sequence
  Description of Artificial Sequence: Synthetic peptide
  MOD_RES (2)..(2): Any amino acid
KXVACK

SEQ ID NO: 3294 - protein, 6 aa, Artificial Sequence
  Description of Artificial Sequence: Synthetic peptide
  MOD_RES (4)..(5): Any amino acid
NQTXXR

SEQ ID NO: 3295 - protein, 5 aa, Artificial Sequence
  Description of Artificial Sequence: Synthetic peptide
  MOD_RES (3)..(3): Any amino acid
KNXAC

SEQ ID NO: 3296 - protein, 6 aa, Artificial Sequence
  Description of Artificial Sequence: Synthetic peptide
  MOD_RES (2)..(2): Any amino acid
  MOD_RES (4)..(5): Any amino acid
NXTXXR

SEQ ID NO: 3297 - protein, 6 aa, Artificial Sequence
  Description of Artificial Sequence: Synthetic peptide
  MOD_RES (2)..(2): Any amino acid
  MOD_RES (4)..(5): Any amino acid
FXTXXR

SEQ ID NO: 3298 - protein, 6 aa, Artificial Sequence
  Description of Artificial Sequence: Synthetic peptide
  MOD_RES (3)..(5): Any amino acid
GYXXXN

SEQ ID NO: 3299 - protein, 6 aa, Artificial Sequence
  Description of Artificial Sequence: Synthetic peptide
  MOD_RES (3)..(3): Any amino acid
NVXCKN

SEQ ID NO: 3300 - protein, 5 aa, Artificial Sequence
  Description of Artificial Sequence: Synthetic peptide
KNVAC

SEQ ID NO: 3301 - protein, 6 aa, Artificial Sequence
  Description of Artificial Sequence: Synthetic peptide
  MOD_RES (2)..(3): Any amino acid
  MOD_RES (5)..(5): Any amino acid
NXXCXN

SEQ ID NO: 3302 - protein, 5 aa, Artificial Sequence
  Description of Artificial Sequence: Synthetic peptide
  MOD_RES (3)..(4): Any amino acid
KNXXC

SEQ ID NO: 3303 - protein, 5 aa, Artificial Sequence
  Description of Artificial Sequence: Synthetic peptide
  MOD_RES (4)..(4): Any amino acid
KNVXC

SEQ ID NO: 3304 - protein, 4 aa, Artificial Sequence
  Description of Artificial Sequence: Synthetic peptide
  MOD_RES (3)..(3): Any amino acid
WCXP

SEQ ID NO: 3305 - protein, 4 aa, Artificial Sequence
  Description of Artificial Sequence: Synthetic peptide
QFNT

SEQ ID NO: 3306 - protein, 6 aa, Artificial Sequence
  Description of Artificial Sequence: Synthetic peptide
  MOD_RES (4)..(4): Any amino acid
KNVXCK

SEQ ID NO: 3307 - protein, 6 aa, Artificial Sequence
  Description of Artificial Sequence: Synthetic peptide
  MOD_RES (3)..(3): Any amino acid
VAXKNG

SEQ ID NO: 3308 - protein, 5 aa, Artificial Sequence
  Description of Artificial Sequence: Synthetic peptide
  MOD_RES (3)..(4): Any amino acid
FRXXD

SEQ ID NO: 3309 - protein, 6 aa, Artificial Sequence
  Description of Artificial Sequence: Synthetic peptide
  MOD_RES (2)..(3): Any amino acid
RXXLPE

SEQ ID NO: 3310 - protein, 4 aa, Artificial Sequence
  Description of Artificial Sequence: Synthetic peptide
  MOD_RES (3)..(3): Any amino acid
FTXS

SEQ ID NO: 3311 - protein, 4 aa, Artificial Sequence
  Description of Artificial Sequence: Synthetic peptide
FTNS

SEQ ID NO: 3312 - protein, 6 aa, Artificial Sequence
  Description of Artificial Sequence: Synthetic peptide
  MOD_RES (2)..(2): Any amino acid
  MOD_RES (4)..(5): Any amino acid
FXGXXA

SEQ ID NO: 3313 - protein, 6 aa, Artificial Sequence
  Description of Artificial Sequence: Synthetic peptide
  MOD_RES (2)..(2): Any amino acid
NXACKN

SEQ ID NO: 3314 - protein, 6 aa, Artificial Sequence
  Description of Artificial Sequence: Synthetic peptide
  MOD_RES (3)..(4): Any amino acid
QTXXAK

SEQ ID NO: 3315 - protein, 6 aa, Artificial Sequence
  Description of Artificial Sequence: Synthetic peptide
  MOD_RES (2)..(2): Any amino acid
  MOD_RES (5)..(5): Any amino acid
SXKPXY

SEQ ID NO: 3316 - protein, 6 aa, Artificial Sequence
  Description of Artificial Sequence: Synthetic peptide
  MOD_RES (2)..(3): Any amino acid
  MOD_RES (5)..(5): Any amino acid
TXXLXK

SEQ ID NO: 3317 - protein, 3 aa, Artificial Sequence
  Description of Artificial Sequence: Synthetic peptide
VAC

SEQ ID NO: 3318 - protein, 6 aa, Artificial Sequence
  Description of Artificial Sequence: Synthetic peptide
  MOD_RES (2)..(5): Any amino acid
EXXXXD

SEQ ID NO: 3319 - protein, 6 aa, Artificial Sequence
  Description of Artificial Sequence: Synthetic peptide
  MOD_RES (3)..(3): Any amino acid
KNXACK

SEQ ID NO: 3320 - protein, 5 aa, Artificial Sequence
  Description of Artificial Sequence: Synthetic peptide
  MOD_RES (2)..(3): Any amino acid
NXXCK

SEQ ID NO: 3321 - protein, 6 aa, Artificial Sequence
  Description of Artificial Sequence: Synthetic peptide
  MOD_RES (2)..(4): Any amino acid
NXXXQF

SEQ ID NO: 3322 - protein, 4 aa, Artificial Sequence
  Description of Artificial Sequence: Synthetic peptide
  MOD_RES (2)..(2): Any amino acid
FXNS

SEQ ID NO: 3323 - protein, 5 aa, Artificial Sequence
  Description of Artificial Sequence: Synthetic peptide
QTPNR

SEQ ID NO: 3324 - protein, 5 aa, Artificial Sequence
  Description of Artificial Sequence: Synthetic peptide
GSTVE

SEQ ID NO: 3325 - protein, 5 aa, Artificial Sequence
  Description of Artificial Sequence: Synthetic peptide
  MOD_RES (2)..(4): Any amino acid
EXXXM

SEQ ID NO: 3326 - protein, 6 aa, Artificial Sequence
  Description of Artificial Sequence: Synthetic peptide
  MOD_RES (3)..(5): Any amino acid
CEXXXY

SEQ ID NO: 3327 - protein, 6 aa, Artificial Sequence
  Description of Artificial Sequence: Synthetic peptide
  MOD_RES (5)..(5): Any amino acid
STVEXT

SEQ ID NO: 3328 - protein, 6 aa, Artificial Sequence
  Description of Artificial Sequence: Synthetic peptide
  MOD_RES (3)..(3): Any amino acid
NQXPNR

SEQ ID NO: 3329 - protein, 6 aa, Artificial Sequence
  Description of Artificial Sequence: Synthetic peptide
  MOD_RES (2)..(3): Any amino acid
MXXSRN

SEQ ID NO: 3330 - protein, 5 aa, Artificial Sequence
  Description of Artificial Sequence: Synthetic peptide
  MOD_RES (4)..(4): Any amino acid
QTPXR

SEQ ID NO: 3331 - protein, 5 aa, Artificial Sequence
  Description of Artificial Sequence: Synthetic peptide
  MOD_RES (3)..(3): Any amino acid
QTXNR

SEQ ID NO: 3332 - protein, 6 aa, Artificial Sequence
  Description of Artificial Sequence: Synthetic peptide
  MOD_RES (3)..(4): Any amino acid
KNXXCK

SEQ ID NO: 3333 - protein, 5 aa, Artificial Sequence
  Description of Artificial Sequence: Synthetic peptide
  MOD_RES (3)..(4): Any amino acid
QFXXN

SEQ ID NO: 3334 - protein, 6 aa, Artificial Sequence
  Description of Artificial Sequence: Synthetic peptide
  MOD_RES (2)..(3): Any amino acid
NXXCKN

SEQ ID NO: 3335 - protein, 5 aa, Artificial Sequence
  Description of Artificial Sequence: Synthetic peptide
  MOD_RES (2)..(2): Any amino acid
  MOD_RES (4)..(4): Any amino acid
GXTXS

SEQ ID NO: 3336 - protein, 4 aa, Artificial Sequence
  Description of Artificial Sequence: Synthetic peptide
WCGP

SEQ ID NO: 3337 - protein, 6 aa, Artificial Sequence
  Description of Artificial Sequence: Synthetic peptide
  MOD_RES (2)..(2): Any amino acid
  MOD_RES (4)..(5): Any amino acid
GXGXXI

SEQ ID NO: 3338 - protein, 6 aa, Artificial Sequence
  Description of Artificial Sequence: Synthetic peptide
  MOD_RES (2)..(3): Any amino acid
NXXPNR

SEQ ID NO: 3339 - protein, 5 aa, Artificial Sequence
  Description of Artificial Sequence: Synthetic peptide
  MOD_RES (2)..(3): Any amino acid
LXXSI

SEQ ID NO: 3340 - protein, 6 aa, Artificial Sequence
  Description of Artificial Sequence: Synthetic peptide
  MOD_RES (2)..(2): Any amino acid
  MOD_RES (5)..(5): Any amino acid
DXPEXL

SEQ ID NO: 3341 - protein, 6 aa, Artificial Sequence
  Description of Artificial Sequence: Synthetic peptide
  MOD_RES (2)..(2): Any amino acid
  MOD_RES (4)..(5): Any amino acid
GXSXXN

SEQ ID NO: 3342 - protein, 6 aa, Artificial Sequence
  Description of Artificial Sequence: Synthetic peptide
  MOD_RES (2)..(3): Any amino acid
  MOD_RES (5)..(5): Any amino acid
CXXGXT

SEQ ID NO: 3343 - protein, 4 aa, Artificial Sequence
  Description of Artificial Sequence: Synthetic peptide
TLIS

SEQ ID NO: 3344 - protein, 6 aa, Artificial Sequence
  Description of Artificial Sequence: Synthetic peptide
  MOD_RES (4)..(4): Any amino acid
FPEXLT

SEQ ID NO: 3345 - protein, 6 aa, Artificial Sequence
  Description of Artificial Sequence: Synthetic peptide
  MOD_RES (2)..(2): Any amino acid
  MOD_RES (5)..(5): Any amino acid
DXQAXC

SEQ ID NO: 3346 - protein, 6 aa, Artificial Sequence
  Description of Artificial Sequence: Synthetic peptide
  MOD_RES (2)..(3): Any amino acid
KXXACK

SEQ ID NO: 3347 - protein, 6 aa, Artificial Sequence
  Description of Artificial Sequence: Synthetic peptide
  MOD_RES (3)..(4): Any amino acid
LSXXYH

SEQ ID NO: 3348 - protein, 4 aa, Artificial Sequence
  Description of Artificial Sequence: Synthetic peptide
CKNG

SEQ ID NO: 3349 - protein, 5 aa, Artificial Sequence
  Description of Artificial Sequence: Synthetic peptide
  MOD_RES (2)..(2): Any amino acid
  MOD_RES (4)..(4): Any amino acid
KXVXC

SEQ ID NO: 3350 - protein, 5 aa, Artificial Sequence
  Description of Artificial Sequence: Synthetic peptide
  MOD_RES (2)..(2): Any amino acid
  MOD_RES (4)..(4): Any amino acid
PXHXA

SEQ ID NO: 3351 - protein, 5 aa, Artificial Sequence
  Description of Artificial Sequence: Synthetic peptide
  MOD_RES (3)..(4): Any amino acid
QTXXR

SEQ ID NO: 3352 - protein, 6 aa, Artificial Sequence
  Description of Artificial Sequence: Synthetic peptide
  MOD_RES (2)..(4): Any amino acid
KXXXCK

SEQ ID NO: 3353 - protein, 3 aa, Artificial Sequence
  Description of Artificial Sequence: Synthetic peptide
SRW

SEQ ID NO: 3354 - protein, 6 aa, Artificial Sequence
  Description of Artificial Sequence: Synthetic peptide
  MOD_RES (2)..(4): Any amino acid
PXXXAL

SEQ ID NO: 3355 - protein, 6 aa, Artificial Sequence
  Description of Artificial Sequence: Synthetic peptide
  MOD_RES (3)..(3): Any amino acid
  MOD_RES (5)..(5): Any amino acid
NQXPXR

SEQ ID NO: 3356 - protein, 5 aa, Artificial Sequence
  Description of Artificial Sequence: Synthetic peptide
  MOD_RES (2)..(3): Any amino acid
KXXAC

SEQ ID NO: 3357 - protein, 4 aa, Artificial Sequence
  Description of Artificial Sequence: Synthetic peptide
KSRW

SEQ ID NO: 3358 - protein, 5 aa, Artificial Sequence
  Description of Artificial Sequence: Synthetic peptide
  MOD_RES (4)..(4): Any amino acid
DKPXY

SEQ ID NO: 3359 - protein, 5 aa, Artificial Sequence
  Description of Artificial Sequence: Synthetic peptide
  MOD_RES (2)..(2): Any amino acid
QXPNR

SEQ ID NO: 3360 - protein, 6 aa, Artificial Sequence
  Description of Artificial Sequence: Synthetic peptide
  MOD_RES (3)..(5): Any amino acid
RIXXXQ

SEQ ID NO: 3361 - protein, 3 aa, Artificial Sequence
  Description of Artificial Sequence: Synthetic peptide
TMS

SEQ ID NO: 3362 - protein, 4 aa, Artificial Sequence
  Description of Artificial Sequence: Synthetic peptide
FNTN

SEQ ID NO: 3363 - protein, 4 aa, Artificial Sequence
  Description of Artificial Sequence: Synthetic peptide
ACKN

SEQ ID NO: 3364 - protein, 6 aa, Artificial Sequence
  Description of Artificial Sequence: Synthetic peptide
  MOD_RES (2)..(2): Any amino acid
  MOD_RES (5)..(5): Any amino acid
SXYQXE

SEQ ID NO: 3365 - protein, 5 aa, Artificial Sequence
  Description of Artificial Sequence: Synthetic peptide
  MOD_RES (2)..(2): Any amino acid
QXNTN

SEQ ID NO: 3366 - protein, 6 aa, Artificial Sequence
  Description of Artificial Sequence: Synthetic peptide
  MOD_RES (2)..(2): Any amino acid
  MOD_RES (4)..(5): Any amino acid
CXNXXT

SEQ ID NO: 3367 - protein, 6 aa, Artificial Sequence
  Description of Artificial Sequence: Synthetic peptide
  MOD_RES (2)..(4): Any amino acid
RXXXDS

SEQ ID NO: 3368 - protein, 4 aa, Artificial Sequence
  Description of Artificial Sequence: Synthetic peptide
YSTM

SEQ ID NO: 3369 - protein, 6 aa, Artificial Sequence
  Description of Artificial Sequence: Synthetic peptide
  MOD_RES (2)..(3): Any amino acid
  MOD_RES (5)..(5): Any amino acid
MXXSXN

SEQ ID NO: 3370 - protein, 4 aa, Artificial Sequence
  Description of Artificial Sequence: Synthetic peptide
KPLY

SEQ ID NO: 3371 - protein, 6 aa, Artificial Sequence
  Description of Artificial Sequence: Synthetic peptide
  MOD_RES (2)..(3): Any amino acid
VXXKNG

SEQ ID NO: 3372 - protein, 6 aa, Artificial Sequence
  Description of Artificial Sequence: Synthetic peptide
  MOD_RES (2)..(3): Any amino acid
  MOD_RES (5)..(5): Any amino acid
LXXKXY

SEQ ID NO: 3373 - protein, 4 aa, Artificial Sequence
  Description of Artificial Sequence: Synthetic peptide
  MOD_RES (2)..(2): Any amino acid
YXTM

SEQ ID NO: 3374 - protein, 5 aa, Artificial Sequence
  Description of Artificial Sequence: Synthetic peptide
  MOD_RES (4)..(4): Any amino acid
GSTXE

SEQ ID NO: 3375 - protein, 6 aa, Artificial Sequence
  Description of Artificial Sequence: Synthetic peptide
  MOD_RES (2)..(2): Any amino acid
  MOD_RES (4)..(5): Any amino acid
LXSXXR

SEQ ID NO: 3376 - protein, 4 aa, Artificial Sequence
  Description of Artificial Sequence: Synthetic peptide
KDYR

SEQ ID NO: 3377 - protein, 6 aa, Artificial Sequence
  Description of Artificial Sequence: Synthetic peptide
  MOD_RES (3)..(4): Any amino acid
VAXXNG

SEQ ID NO: 3378 - protein, 5 aa, Artificial Sequence
  Description of Artificial Sequence: Synthetic peptide
  MOD_RES (4)..(4): Any amino acid
NVAXK

SEQ ID NO: 3379 - protein, 4 aa, Artificial Sequence
  Description of Artificial Sequence: Synthetic peptide
  MOD_RES (3)..(3): Any amino acid
YSXM

SEQ ID NO: 3380 - protein, 4 aa, Artificial Sequence
  Description of Artificial Sequence: Synthetic peptide
TPNR

SEQ ID NO: 3381 - protein, 5 aa, Artificial Sequence
  Description of Artificial Sequence: Synthetic peptide
  MOD_RES (2)..(3): Any amino acid
GXXNS

SEQ ID NO: 3382 - protein, 6 aa, Artificial Sequence
  Description of Artificial Sequence: Synthetic peptide
  MOD_RES (4)..(5): Any amino acid
FPEXXT

SEQ ID NO: 3383 - protein, 6 aa, Artificial Sequence
  Description of Artificial Sequence: Synthetic peptide
  MOD_RES (2)..(2): Any amino acid
  MOD_RES (5)..(5): Any amino acid
DXREXG

SEQ ID NO: 3384 - protein, 6 aa, Artificial Sequence
  Description of Artificial Sequence: Synthetic peptide
  MOD_RES (3)..(4): Any amino acid
YHXXNE

SEQ ID NO: 3385 - protein, 6 aa, Artificial Sequence
  Description of Artificial Sequence: Synthetic peptide
  MOD_RES (2)..(2): Any amino acid
  MOD_RES (4)..(5): Any amino acid
SXYXXE

SEQ ID NO: 3386 - protein, 4 aa, Artificial Sequence
  Description of Artificial Sequence: Synthetic peptide
MNIF

SEQ ID NO: 3387 - protein, 3 aa, Artificial Sequence
  Description of Artificial Sequence: Synthetic peptide
MDS

SEQ ID NO: 3388 - protein, 5 aa, Artificial Sequence
  Description of Artificial Sequence: Synthetic peptide
  MOD_RES (3)..(3): Any amino acid
GSXVE

SEQ ID NO: 3389 - protein, 6 aa, Artificial Sequence
  Description of Artificial Sequence: Synthetic peptide
  MOD_RES (3)..(5): Any amino acid
CKXXXT

SEQ ID NO: 3390 - protein, 6 aa, Artificial Sequence
  Description of Artificial Sequence: Synthetic peptide
  MOD_RES (4)..(5): Any amino acid
NPTXXE

SEQ ID NO: 3391 - protein, 6 aa, Artificial Sequence
  Description of Artificial Sequence: Synthetic peptide
  MOD_RES (2)..(5): Any amino acid
FXXXXQ

SEQ ID NO: 3392 - protein, 5 aa, Artificial Sequence
  Description of Artificial Sequence: Synthetic peptide
  MOD_RES (2)..(3): Any amino acid
MXXSR

SEQ ID NO: 3393 - protein, 3 aa, Artificial Sequence
  Description of Artificial Sequence: Synthetic peptide
CGP

SEQ ID NO: 3394 - protein, 6 aa, Artificial Sequence
  Description of Artificial Sequence: Synthetic peptide
  MOD_RES (4)..(5): Any amino acid
KETXXA

SEQ ID NO: 3395 - protein, 5 aa, Artificial Sequence
  Description of Artificial Sequence: Synthetic peptide
  MOD_RES (3)..(4): Any amino acid
YHXXN

SEQ ID NO: 3396 - protein, 5 aa, Artificial Sequence
  Description of Artificial Sequence: Synthetic peptide
QDKEG

SEQ ID NO: 3397 - protein, 5 aa, Artificial Sequence
  Description of Artificial Sequence: Synthetic peptide
  MOD_RES (4)..(4): Any amino acid
FPEXL

SEQ ID NO: 3398 - protein, 5 aa, Artificial Sequence
  Description of Artificial Sequence: Synthetic peptide
  MOD_RES (2)..(2): Any amino acid
  MOD_RES (4)..(4): Any amino acid
QXPXR

SEQ ID NO: 3399 - protein, 4 aa, Artificial Sequence
  Description of Artificial Sequence: Synthetic peptide
PGPP

SEQ ID NO: 3400 - protein, 3 aa, Artificial Sequence
  Description of Artificial Sequence: Synthetic peptide
STM

SEQ ID NO: 3401 - protein, 5 aa, Artificial Sequence
  Description of Artificial Sequence: Synthetic peptide
  MOD_RES (2)..(3): Any amino acid
SXXYH

SEQ ID NO: 3402 - protein, 6 aa, Artificial Sequence
  Description of Artificial Sequence: Synthetic peptide
STKVDK

SEQ ID NO: 3403 - protein, 6 aa, Artificial Sequence
  Description of Artificial Sequence: Synthetic peptide
  MOD_RES (2)..(2): Any amino acid
  MOD_RES (5)..(5): Any amino acid
KXVAXK

SEQ ID NO: 3404 - protein, 5 aa, Artificial Sequence
  Description of Artificial Sequence: Synthetic peptide
  MOD_RES (2)..(4): Any amino acid
VXXXQ

SEQ ID NO: 3405 - protein, 5 aa, Artificial Sequence
  Description of Artificial Sequence: Synthetic peptide
  MOD_RES (3)..(4): Any amino acid
LGXXI

SEQ ID NO: 3406 - protein, 6 aa, Artificial Sequence
  Description of Artificial Sequence: Synthetic peptide
  MOD_RES (3)..(5): Any amino acid
VAXXXG

SEQ ID NO: 3407 - protein, 6 aa, Artificial Sequence
  Description of Artificial Sequence: Synthetic peptide
  MOD_RES (2)..(5): Any amino acid
MXXXXS

SEQ ID NO: 3408 - protein, 5 aa, Artificial Sequence
  Description of Artificial Sequence: Synthetic peptide
  MOD_RES (2)..(2): Any amino acid
  MOD_RES (4)..(4): Any amino acid
QXNXN

SEQ ID NO: 3409 - protein, 5 aa, Artificial Sequence
  Description of Artificial Sequence: Synthetic peptide
  MOD_RES (4)..(4): Any amino acid
ETGXS

SEQ ID NO: 3410 - protein, 6 aa, Artificial Sequence
  Description of Artificial Sequence: Synthetic peptide
  MOD_RES (2)..(2): Any amino acid
  MOD_RES (4)..(5): Any amino acid
TXDXXR

SEQ ID NO: 3411 - protein, 5 aa, Artificial Sequence
  Description of Artificial Sequence: Synthetic peptide
  MOD_RES (2)..(2): Any amino acid
EXGSS

SEQ ID NO: 3412 - protein, 5 aa, Artificial Sequence
  Description of Artificial Sequence: Synthetic peptide
  MOD_RES (2)..(3): Any amino acid
QXXNR

SEQ ID NO: 3413 - protein, 6 aa, Artificial Sequence
  Description of Artificial Sequence: Synthetic peptide
  MOD_RES (3)..(5): Any amino acid
PGXXXL

SEQ ID NO: 3414 - protein, 3 aa, Artificial Sequence
  Description of Artificial Sequence: Synthetic peptide
QFN

SEQ ID NO: 3415 - protein, 6 aa, Artificial Sequence
  Description of Artificial Sequence: Synthetic peptide
  MOD_RES (3)..(5): Any amino acid
NMXXXE

SEQ ID NO: 3416 - protein, 6 aa, Artificial Sequence
  Description of Artificial Sequence: Synthetic peptide
  MOD_RES (2)..(2): Any amino acid
  MOD_RES (5)..(5): Any amino acid
NXRGXS

SEQ ID NO: 3417 - protein, 3 aa, Artificial Sequence
  Description of Artificial Sequence: Synthetic peptide
WCG

SEQ ID NO: 3418 - protein, 5 aa, Artificial Sequence
  Description of Artificial Sequence: Synthetic peptide
  MOD_RES (3)..(3): Any amino acid
VAXKN

SEQ ID NO: 3419 - protein, 5 aa, Artificial Sequence
  Description of Artificial Sequence: Synthetic peptide
NQTPN

SEQ ID NO: 3420 - protein, 4 aa, Artificial Sequence
  Description of Artificial Sequence: Synthetic peptide
  MOD_RES (2)..(2): Any amino acid
NXGY

SEQ ID NO: 3421 - protein, 4 aa, Artificial Sequence
  Description of Artificial Sequence: Synthetic peptide
  MOD_RES (2)..(2): Any amino acid
DXPE

SEQ ID NO: 3422 - protein, 5 aa, Artificial Sequence
  Description of Artificial Sequence: Synthetic peptide
  MOD_RES (2)..(2): Any amino acid
  MOD_RES (4)..(4): Any amino acid
QXNXQ

SEQ ID NO: 3423 - protein, 5 aa, Artificial Sequence
  Description of Artificial Sequence: Synthetic peptide
  MOD_RES (4)..(4): Any amino acid
QDKXG

SEQ ID NO: 3424 - protein, 4 aa, Artificial Sequence
  Description of Artificial Sequence: Synthetic peptide
GFTN

SEQ ID NO: 3425 - protein, 4 aa, Artificial Sequence
  Description of Artificial Sequence: Synthetic peptide
STVE

SEQ ID NO: 3426 - protein, 5 aa, Artificial Sequence
  Description of Artificial Sequence: Synthetic peptide
  MOD_RES (3)..(3): Any amino acid
QDXEG

SEQ ID NO: 3427 - protein, 6 aa, Artificial Sequence
  Description of Artificial Sequence: Synthetic peptide
  MOD_RES (2)..(4): Any amino acid
LXXXYH

SEQ ID NO: 3428 - protein, 4 aa, Artificial Sequence
  Description of Artificial Sequence: Synthetic peptide
  MOD_RES (3)..(3): Any amino acid
KSXW

SEQ ID NO: 3429 - protein, 5 aa, Artificial Sequence
  Description of Artificial Sequence: Synthetic peptide
  MOD_RES (2)..(2): Any amino acid
PXGPP

SEQ ID NO: 3430 - protein, 5 aa, Artificial Sequence
  Description of Artificial Sequence: Synthetic peptide
  MOD_RES (2)..(2): Any amino acid
  MOD_RES (4)..(4): Any amino acid
NXAXK

SEQ ID NO: 3431 - protein, 4 aa, Artificial Sequence
  Description of Artificial Sequence: Synthetic peptide
  MOD_RES (2)..(2): Any amino acid
MXIF

SEQ ID NO: 3432 - protein, 5 aa, Artificial Sequence
  Description of Artificial Sequence: Synthetic peptide
  MOD_RES (2)..(2): Any amino acid
  MOD_RES (4)..(4): Any amino acid
GXLXL

SEQ ID NO: 3433 - protein, 5 aa, Artificial Sequence
  Description of Artificial Sequence: Synthetic peptide
  MOD_RES (2)..(2): Any amino acid
GXTVE

SEQ ID NO: 3434 - protein, 5 aa, Artificial Sequence
  Description of Artificial Sequence: Synthetic peptide
  MOD_RES (3)..(4): Any amino acid
ACXXG

SEQ ID NO: 3435 - protein, 6 aa, Artificial Sequence
  Description of Artificial Sequence: Synthetic peptide
  MOD_RES (2)..(3): Any amino acid
  MOD_RES (5)..(5): Any amino acid
NXXGXS

SEQ ID NO: 3436 - protein, 6 aa, Artificial Sequence
  Description of Artificial Sequence: Synthetic peptide
  MOD_RES (2)..(3): Any amino acid
  MOD_RES (5)..(5): Any amino acid
EXXLXY

SEQ ID NO: 3437 - protein, 5 aa, Artificial Sequence
  Description of Artificial Sequence: Synthetic peptide
  MOD_RES (2)..(2): Any amino acid
  MOD_RES (4)..(4): Any amino acid
QXQXN

SEQ ID NO: 3438 - protein, 4 aa, Artificial Sequence
  Description of Artificial Sequence: Synthetic peptide
  MOD_RES (2)..(2): Any amino acid
TXNR

SEQ ID NO: 3439 - protein, 6 aa, Artificial Sequence
  Description of Artificial Sequence: Synthetic peptide
  MOD_RES (2)..(3): Any amino acid
  MOD_RES (5)..(5): Any amino acid
VXXKXG

SEQ ID NO: 3440 - protein, 4 aa, Artificial Sequence
  Description of Artificial Sequence: Synthetic peptide
  MOD_RES (2)..(2): Any amino acid
QXNT

SEQ ID NO: 3441 - protein, 6 aa, Artificial Sequence
  Description of Artificial Sequence: Synthetic peptide
  MOD_RES (2)..(3): Any amino acid
DXXGNG

SEQ ID NO: 3442 - protein, 6 aa, Artificial Sequence
  Description of Artificial Sequence: Synthetic peptide
  MOD_RES (3)..(4): Any amino acid
FPXXLT

SEQ ID NO: 3443 - protein, 4 aa, Artificial Sequence
  Description of Artificial Sequence: Synthetic peptide
  MOD_RES (2)..(2): Any amino acid
FXTN

SEQ ID NO: 3444 - protein, 5 aa, Artificial Sequence
  Description of Artificial Sequence: Synthetic peptide
  MOD_RES (2)..(2): Any amino acid
NXTPN

SEQ ID NO: 3445 - protein, 5 aa, Artificial Sequence
  Description of Artificial Sequence: Synthetic peptide
  MOD_RES (2)..(2): Any amino acid
AXKNG

SEQ ID NO: 3446 - protein, 4 aa, Artificial Sequence
  Description of Artificial Sequence: Synthetic peptide
DSVT

SEQ ID NO: 3447 - protein, 6 aa, Artificial Sequence
  Description of Artificial Sequence: Synthetic peptide
NTKVDK

SEQ ID NO: 3448 - protein, 5 aa, Artificial Sequence
  Description of Artificial Sequence: Synthetic peptide
  MOD_RES (2)..(2): Any amino acid
QXKEG

SEQ ID NO: 3449 - protein, 6 aa, Artificial Sequence
  Description of Artificial Sequence: Synthetic peptide
  MOD_RES (4)..(4): Any amino acid
STKXDK

SEQ ID NO: 3450 - protein, 6 aa, Artificial Sequence
  Description of Artificial Sequence: Synthetic peptide
  MOD_RES (5)..(5): Any amino acid
STKVXK

SEQ ID NO: 3451 - protein, 5 aa, Artificial Sequence
  Description of Artificial Sequence: Synthetic peptide
  MOD_RES (3)..(3): Any amino acid
NQXPN

SEQ ID NO: 3452 - protein, 4 aa, Artificial Sequence
  Description of Artificial Sequence: Synthetic peptide
GSTV

SEQ ID NO: 3453 - protein, 6 aa, Artificial Sequence
  Description of Artificial Sequence: Synthetic peptide
  MOD_RES (2)..(4): Any amino acid
DXXXGS

SEQ ID NO: 3454 - protein, 6 aa, Artificial Sequence
  Description of Artificial Sequence: Synthetic peptide
  MOD_RES (2)..(5): Any amino acid
YXXXXA

SEQ ID NO: 3455 - protein, 6 aa, Artificial Sequence
  Description of Artificial Sequence: Synthetic peptide
  MOD_RES (2)..(2): Any amino acid
SXKVDK

SEQ ID NO: 3456 - protein, 5 aa, Artificial Sequence
  Description of Artificial Sequence: Synthetic peptide
  MOD_RES (4)..(4): Any amino acid
PPGXP

SEQ ID NO: 3457 - protein, 6 aa, Artificial Sequence
  Description of Artificial Sequence: Synthetic peptide
  MOD_RES (4)..(5): Any amino acid
GIPXXQ

SEQ ID NO: 3458 - protein, 4 aa, Artificial Sequence
  Description of Artificial Sequence: Synthetic peptide
  MOD_RES (3)..(3): Any amino acid
MDXS

SEQ ID NO: 3459 - protein, 5 aa, Artificial Sequence
  Description of Artificial Sequence: Synthetic peptide
  MOD_RES (4)..(4): Any amino acid
NQTXN

SEQ ID NO: 3460 - protein, 4 aa, Artificial Sequence
  Description of Artificial Sequence: Synthetic peptide
  MOD_RES (2)..(2): Any amino acid
WXGP

SEQ ID NO: 3461 - protein, 5 aa, Artificial Sequence
  Description of Artificial Sequence: Synthetic peptide
  MOD_RES (4)..(4): Any amino acid
DGDXQ

SEQ ID NO: 3462 - protein, 6 aa, Artificial Sequence
  Description of Artificial Sequence: Synthetic peptide
  MOD_RES (3)..(3): Any amino acid
STXVDK

SEQ ID NO: 3463 - protein, 5 aa, Artificial Sequence
  Description of Artificial Sequence: Synthetic peptide
  MOD_RES (2)..(3): Any amino acid
QXXTN

SEQ ID NO: 3464 - protein, 6 aa, Artificial Sequence
  Description of Artificial Sequence: Synthetic peptide
TKVDKK

SEQ ID NO: 3465 - protein, 4 aa, Artificial Sequence
  Description of Artificial Sequence: Synthetic peptide
  MOD_RES (3)..(3): Any amino acid
PFXA

SEQ ID NO: 3466 - protein, 4 aa, Artificial Sequence
  Description of Artificial Sequence: Synthetic peptide
PPGP

SEQ ID NO: 3467 - protein, 6 aa, Artificial Sequence
  Description of Artificial Sequence: Synthetic peptide
SSTKVD

SEQ ID NO: 3468 - protein, 5 aa, Artificial Sequence
  Description of Artificial Sequence: Synthetic peptide
  MOD_RES (3)..(4): Any amino acid
ISXXT

SEQ ID NO: 3469 - protein, 5 aa, Artificial Sequence
  Description of Artificial Sequence: Synthetic peptide
  MOD_RES (2)..(3): Any amino acid
LXXNV

SEQ ID NO: 3470 - protein, 6 aa, Artificial Sequence
  Description of Artificial Sequence: Synthetic peptide
  MOD_RES (4)..(4): Any amino acid
QSPXSL

SEQ ID NO: 3471 - protein, 6 aa, Artificial Sequence
  Description of Artificial Sequence: Synthetic peptide
  MOD_RES (2)..(2): Any amino acid
  MOD_RES (4)..(5): Any amino acid
LXAXXR

SEQ ID NO: 3472 - protein, 6 aa, Artificial Sequence
  Description of Artificial Sequence: Synthetic peptide
  MOD_RES (2)..(5): Any amino acid
GXXXXN

SEQ ID NO: 3473 - protein, 6 aa, Artificial Sequence
  Description of Artificial Sequence: Synthetic peptide
  MOD_RES (2)..(5): Any amino acid
QXXXXI

SEQ ID NO: 3474 - protein, 4 aa, Artificial Sequence
  Description of Artificial Sequence: Synthetic peptide
  MOD_RES (3)..(3): Any amino acid
GFXN

SEQ ID NO: 3475 - protein, 4 aa, Artificial Sequence
  Description of Artificial Sequence: Synthetic peptide
  MOD_RES (2)..(3): Any amino acid
NXXC

SEQ ID NO: 3476 - protein, 5 aa, Artificial Sequence
  Description of Artificial Sequence: Synthetic peptide
  MOD_RES (2)..(2): Any amino acid
  MOD_RES (4)..(4): Any amino acid
NXTXN

SEQ ID NO: 3477 - protein, 6 aa, Artificial Sequence
  Description of Artificial Sequence: Synthetic peptide
  MOD_RES (2)..(5): Any amino acid
RXXXXD

SEQ ID NO: 3478 - protein, 5 aa, Artificial Sequence
  Description of Artificial Sequence: Synthetic peptide
  MOD_RES (2)..(3): Any amino acid
NXXGV

SEQ ID NO: 3479 - protein, 4 aa, Artificial Sequence
  Description of Artificial Sequence: Synthetic peptide
  MOD_RES (2)..(3): Any amino acid
RXXM

SEQ ID NO: 3480 - protein, 6 aa, Artificial Sequence
  Description of Artificial Sequence: Synthetic peptide
  MOD_RES (3)..(5): Any amino acid
AEXXXV

SEQ ID NO: 3481 - protein, 6 aa, Artificial Sequence
  Description of Artificial Sequence: Synthetic peptide
  MOD_RES (2)..(2): Any amino acid
NXKVDK

SEQ ID NO: 3482 - protein, 6 aa, Artificial Sequence
  Description of Artificial Sequence: Synthetic peptide
  MOD_RES (3)..(5): Any amino acid
GLXXXQ

SEQ ID NO: 3483 - protein, 6 aa, Artificial Sequence
  Description of Artificial Sequence: Synthetic peptide
  MOD_RES (4)..(4): Any amino acid
NTKXDK

SEQ ID NO: 3484 - protein, 6 aa, Artificial Sequence
  Description of Artificial Sequence: Synthetic peptide
  MOD_RES (2)..(5): Any amino acid
LXXXXM

SEQ ID NO: 3485 - protein, 6 aa, Artificial Sequence
  Description of Artificial Sequence: Synthetic peptide
  MOD_RES (2)..(5): Any amino acid
FXXXXE

SEQ ID NO: 3486 - protein, 6 aa, Artificial Sequence
  Description of Artificial Sequence: Synthetic peptide
  MOD_RES (2)..(2): Any amino acid
  MOD_RES (5)..(5): Any amino acid
SXKVXK

SEQ ID NO: 3487 - protein, 6 aa, Artificial Sequence
  Description of Artificial Sequence: Synthetic peptide
  MOD_RES (3)..(3): Any amino acid
NTXVDK

SEQ ID NO: 3488 - protein, 4 aa, Artificial Sequence
  Description of Artificial Sequence: Synthetic peptide
  MOD_RES (3)..(3): Any amino acid
KQXT

SEQ ID NO: 3489 - protein, 5 aa, Artificial Sequence
  Description of Artificial Sequence: Synthetic peptide
  MOD_RES (2)..(3): Any amino acid
QXXCS

SEQ ID NO: 3490 - protein, 6 aa, Artificial Sequence
  Description of Artificial Sequence: Synthetic peptide
  MOD_RES (2)..(2): Any amino acid
  MOD_RES (4)..(4): Any amino acid
SXKXDK

SEQ ID NO: 3491 - protein, 6 aa, Artificial Sequence
  Description of Artificial Sequence: Synthetic peptide
  MOD_RES (2)..(2): Any amino acid
  MOD_RES (4)..(5): Any amino acid
LXPXXR

SEQ ID NO: 3492 - protein, 6 aa, Artificial Sequence
  Description of Artificial Sequence: Synthetic peptide
  MOD_RES (3)..(3): Any amino acid
  MOD_RES (5)..(5): Any amino acid
STXVXK

SEQ ID NO: 3493 - protein, 6 aa, Artificial Sequence
  Description of Artificial Sequence: Synthetic peptide
  MOD_RES (2)..(2): Any amino acid
  MOD_RES (4)..(5): Any amino acid
GXPXXQ

SEQ ID NO: 3494 - protein, 6 aa, Artificial Sequence
  Description of Artificial Sequence: Synthetic peptide
  MOD_RES (3)..(5): Any amino acid
NPXXXE

SEQ ID NO: 3495 - protein, 4 aa, Artificial Sequence
  Description of Artificial Sequence: Synthetic peptide
QTPN

SEQ ID NO: 3496 - protein, 5 aa, Artificial Sequence
  Description of Artificial Sequence: Synthetic peptide
  MOD_RES (2)..(2): Any amino acid
  MOD_RES (4)..(4): Any amino acid
EXGXS

SEQ ID NO: 3497 - protein, 6 aa, Artificial Sequence
  Description of Artificial Sequence: Synthetic peptide
  MOD_RES (5)..(5): Any amino acid
NTKVXK

SEQ ID NO: 3498 - protein, 6 aa, Artificial Sequence
  Description of Artificial Sequence: Synthetic peptide
  MOD_RES (3)..(5): Any amino acid
LSXXXH

SEQ ID NO: 3499 - protein, 6 aa, Artificial Sequence
  Description of Artificial Sequence: Synthetic peptide
  MOD_RES (3)..(5): Any amino acid
FPXXXT

SEQ ID NO: 3500 - protein, 6 aa, Artificial Sequence
  Description of Artificial Sequence: Synthetic peptide
  MOD_RES (2)..(5): Any amino acid
RXXXXY

SEQ ID NO: 3501 - protein, 6 aa, Artificial Sequence
  Description of Artificial Sequence: Synthetic peptide
  MOD_RES (2)..(5): Any amino acid
KXXXXY

SEQ ID NO: 3502 - protein, 6 aa, Artificial Sequence
  Description of Artificial Sequence: Synthetic peptide
  MOD_RES (3)..(5): Any amino acid
GIXXXQ

SEQ ID NO: 3503 - protein, 6 aa, Artificial Sequence
  Description of Artificial Sequence: Synthetic peptide
  MOD_RES (2)..(2): Any amino acid
  MOD_RES (4)..(5): Any amino acid
QXRXXE

SEQ ID NO: 3504 - protein, 3 aa, Artificial Sequence
  Description of Artificial Sequence: Synthetic peptide
LCT

SEQ ID NO: 3505 - protein, 4 aa, Artificial Sequence
  Description of Artificial Sequence: Synthetic peptide
  MOD_RES (2)..(2): Any amino acid
PXVY

SEQ ID NO: 3506 - protein, 4 aa, Artificial Sequence
  Description of Artificial Sequence: Synthetic peptide
NPTE

SEQ ID NO: 3507 - protein, 6 aa, Artificial Sequence
  Description of Artificial Sequence: Synthetic peptide
  MOD_RES (4)..(5): Any amino acid
STKXXK

SEQ ID NO: 3508 - protein, 4 aa, Artificial Sequence
  Description of Artificial Sequence: Synthetic peptide
  MOD_RES (3)..(3): Any amino acid
MNXF

SEQ ID NO: 3509 - protein, 5 aa, Artificial Sequence
  Description of Artificial Sequence: Synthetic peptide
  MOD_RES (3)..(4): Any amino acid
NVXXK

SEQ ID NO: 3510 - protein, 4 aa, Artificial Sequence
  Description of Artificial Sequence: Synthetic peptide
KNVA

SEQ ID NO: 3511 - protein, 6 aa, Artificial Sequence
  Description of Artificial Sequence: Synthetic peptide
  MOD_RES (2)..(4): Any amino acid
RXXXTD

SEQ ID NO: 3512 - protein, 6 aa, Artificial Sequence
  Description of Artificial Sequence: Synthetic peptide
  MOD_RES (3)..(4): Any amino acid
EAXXAE

SEQ ID NO: 3513 - protein, 6 aa, Artificial Sequence
  Description of Artificial Sequence: Synthetic peptide
  MOD_RES (2)..(4): Any amino acid
VXXXNG

SEQ ID NO: 3514 - protein, 5 aa, Artificial Sequence
  Description of Artificial Sequence: Synthetic peptide
  MOD_RES (2)..(4): Any amino acid
RXXXD

SEQ ID NO: 3515 - protein, 3 aa, Artificial Sequence
  Description of Artificial Sequence: Synthetic peptide
FNT

SEQ ID NO: 3516 - protein, 6 aa, Artificial Sequence
  Description of Artificial Sequence: Synthetic peptide
  MOD_RES (3)..(3): Any amino acid
TKXDKK

SEQ ID NO: 3517 - protein, 6 aa, Artificial Sequence
  Description of Artificial Sequence: Synthetic peptide
  MOD_RES (3)..(3): Any amino acid
SSXKVD

SEQ ID NO: 3518 - protein, 6 aa, Artificial Sequence
  Description of Artificial Sequence: Synthetic peptide
  MOD_RES (4)..(4): Any amino acid
TKVXKK

SEQ ID NO: 3519 - protein, 6 aa, Artificial Sequence
  Description of Artificial Sequence: Synthetic peptide
  MOD_RES (2)..(3): Any amino acid
  MOD_RES (5)..(5): Any amino acid
PXXLXV

SEQ ID NO: 3520 - protein, 6 aa, Artificial Sequence
  Description of Artificial Sequence: Synthetic peptide
  MOD_RES (2)..(4): Any amino acid
YXXXNE

SEQ ID NO: 3521 - protein, 6 aa, Artificial Sequence
  Description of Artificial Sequence: Synthetic peptide
  MOD_RES (3)..(5): Any amino acid
LSXXXQ

SEQ ID NO: 3522 - protein, 6 aa, Artificial Sequence
  Description of Artificial Sequence: Synthetic peptide
  MOD_RES (3)..(5): Any amino acid
KEXXXA

SEQ ID NO: 3523 - protein, 6 aa, Artificial Sequence
  Description of Artificial Sequence: Synthetic peptide
  MOD_RES (2)..(3): Any amino acid
  MOD_RES (5)..(5): Any amino acid
RXXDXD

SEQ ID NO: 3524 - protein, 6 aa, Artificial Sequence
  Description of Artificial Sequence: Synthetic peptide
  MOD_RES (2)..(2): Any amino acid
  MOD_RES (4)..(4): Any amino acid
QXPXSL

SEQ ID NO: 3525 - protein, 6 aa, Artificial Sequence
  Description of Artificial Sequence: Synthetic peptide
  MOD_RES (4)..(4): Any amino acid
SSTXVD

SEQ ID NO: 3526 - protein, 6 aa, Artificial Sequence
  Description of Artificial Sequence: Synthetic peptide
  MOD_RES (2)..(2): Any amino acid
TXVDKK

SEQ ID NO: 3527 - protein, 6 aa, Artificial Sequence
  Description of Artificial Sequence: Synthetic peptide
  MOD_RES (4)..(5): Any amino acid
QSPXXL

SEQ ID NO: 3528 - protein, 4 aa, Artificial Sequence
  Description of Artificial Sequence: Synthetic peptide
  MOD_RES (2)..(2): Any amino acid
CXNG

SEQ ID NO: 3529 - protein, 4 aa, Artificial Sequence
  Description of Artificial Sequence: Synthetic peptide
DKEG

SEQ ID NO: 3530 - protein, 5 aa, Artificial Sequence
  Description of Artificial Sequence: Synthetic peptide
STKVD

SEQ ID NO: 3531 - protein, 4 aa, Artificial Sequence
  Description of Artificial Sequence: Synthetic peptide
  MOD_RES (2)..(2): Any amino acid
NXRG

SEQ ID NO: 3532 - protein, 3 aa, Artificial Sequence
  Description of Artificial Sequence: Synthetic peptide
NIF

SEQ ID NO: 3533 - protein, 6 aa, Artificial Sequence
  Description of Artificial Sequence: Synthetic peptide
  MOD_RES (5)..(5): Any amino acid
SSTKXD

SEQ ID NO: 3534 - protein, 4 aa, Artificial Sequence
  Description of Artificial Sequence: Synthetic peptide
  MOD_RES (2)..(2): Any amino acid
SXYQ

SEQ ID NO: 3535 - protein, 5 aa, Artificial Sequence
  Description of Artificial Sequence: Synthetic peptide
  MOD_RES (3)..(4): Any amino acid
QDXXG

SEQ ID NO: 3536 - protein, 6 aa, Artificial Sequence
  Description of Artificial Sequence: Synthetic peptide
  MOD_RES (5)..(5): Any amino acid
TKVDXK

SEQ ID NO: 3537 - protein, 6 aa, Artificial Sequence
  Description of Artificial Sequence: Synthetic peptide
  MOD_RES (3)..(5): Any amino acid
LPXXXR

SEQ ID NO: 3538 - protein, 6 aa, Artificial Sequence
  Description of Artificial Sequence: Synthetic peptide
  MOD_RES (2)..(2): Any amino acid
  MOD_RES (4)..(4): Any amino acid
NXKXDK

SEQ ID NO: 3539 - protein, 4 aa, Artificial Sequence
  Description of Artificial Sequence: Synthetic peptide
  MOD_RES (3)..(3): Any amino acid
CKXG

SEQ ID NO: 3540 - protein, 4 aa, Artificial Sequence
  Description of Artificial Sequence: Synthetic peptide
  MOD_RES (3)..(3): Any amino acid
VAXK

SEQ ID NO: 3541 - protein, 5 aa, Artificial Sequence
  Description of Artificial Sequence: Synthetic peptide
  MOD_RES (3)..(4): Any amino acid
EGXXY

SEQ ID NO: 3542 - protein, 6 aa, Artificial Sequence
  Description of Artificial Sequence: Synthetic peptide
  MOD_RES (2)..(4): Any amino acid
AXXXGV

SEQ ID NO: 3543 - protein, 6 aa, Artificial Sequence
  Description of Artificial Sequence: Synthetic peptide
  MOD_RES (3)..(4): Any amino acid
QSXXSL

SEQ ID NO: 3544 - protein, 6 aa, Artificial Sequence
  Description of Artificial Sequence: Synthetic peptide
  MOD_RES (2)..(5): Any amino acid
QXXXXT

SEQ ID NO: 3545 - protein, 6 aa, Artificial Sequence
  Description of Artificial Sequence: Synthetic peptide
  MOD_RES (2)..(2): Any amino acid
  MOD_RES (4)..(5): Any amino acid
LXPXXQ

SEQ ID NO: 3546 - protein, 3 aa, Artificial Sequence
  Description of Artificial Sequence: Synthetic peptide
NVA

SEQ ID NO: 3547 - protein, 6 aa, Artificial Sequence
  Description of Artificial Sequence: Synthetic peptide
  MOD_RES (3)..(5): Any amino acid
GFXXXD

SEQ ID NO: 3548 - protein, 6 aa, Artificial Sequence
  Description of Artificial Sequence: Synthetic peptide
  MOD_RES (2)..(3): Any amino acid
SXXVDK

SEQ ID NO: 3549 - protein, 3 aa, Artificial Sequence
  Description of Artificial Sequence: Synthetic peptide
TNS

SEQ ID NO: 3550 - protein, 4 aa, Artificial Sequence
  Description of Artificial Sequence: Synthetic peptide
  MOD_RES (3)..(3): Any amino acid
QTXN

SEQ ID NO: 3551 - protein, 4 aa, Artificial Sequence
  Description of Artificial Sequence: Synthetic peptide
  MOD_RES (2)..(2): Any amino acid
GXTN

SEQ ID NO: 3552 - protein, 6 aa, Artificial Sequence
  Description of Artificial Sequence: Synthetic peptide
  MOD_RES (3)..(3): Any amino acid
  MOD_RES (5)..(5): Any amino acid
NTXVXK

SEQ ID NO: 3553 - protein, 3 aa, Artificial Sequence
  Description of Artificial Sequence: Synthetic peptide
ACK

SEQ ID NO: 3554 - protein, 6 aa, Artificial Sequence
  Description of Artificial Sequence: Synthetic peptide
  MOD_RES (2)..(5): Any amino acid
FXXXXY

SEQ ID NO: 3555 - protein, 6 aa, Artificial Sequence
  Description of Artificial Sequence: Synthetic peptide
  MOD_RES (2)..(2): Any amino acid
SXTKVD

SEQ ID NO: 3556 - protein, 6 aa, Artificial Sequence
  Description of Artificial Sequence: Synthetic peptide
  MOD_RES (2)..(5): Any amino acid
IXXXXY

SEQ ID NO: 3557 - protein, 6 aa, Artificial Sequence
  Description of Artificial Sequence: Synthetic peptide
  MOD_RES (2)..(2): Any amino acid
  MOD_RES (5)..(5): Any amino acid
NXKVXK

SEQ ID NO: 3558 - protein, 5 aa, Artificial Sequence
  Description of Artificial Sequence: Synthetic peptide
  MOD_RES (2)..(3): Any amino acid
NXXPN

SEQ ID NO: 3559 - protein, 6 aa, Artificial Sequence
  Description of Artificial Sequence: Synthetic peptide
  MOD_RES (2)..(5): Any amino acid
WXXXXR

SEQ ID NO: 3560 - protein, 6 aa, Artificial Sequence
  Description of Artificial Sequence: Synthetic peptide
  MOD_RES (2)..(5): Any amino acid
EXXXXR

SEQ ID NO: 3561 - protein, 4 aa, Artificial Sequence
  Description of Artificial Sequence: Synthetic peptide
  MOD_RES (3)..(3): Any amino acid
ACXN

SEQ ID NO: 3562 - protein, 6 aa, Artificial Sequence
  Description of Artificial Sequence: Synthetic peptide
  MOD_RES (2)..(2): Any amino acid
  MOD_RES (4)..(5): Any amino acid
GXSXXT

SEQ ID NO: 3563 - protein, 6 aa, Artificial Sequence
  Description of Artificial Sequence: Synthetic peptide
  MOD_RES (2)..(2): Any amino acid
  MOD_RES (4)..(5): Any amino acid
QXPXXL

SEQ ID NO: 3564 - protein, 5 aa, Artificial Sequence
  Description of Artificial Sequence: Synthetic peptide
  MOD_RES (2)..(4): Any amino acid
FXXXD

SEQ ID NO: 3565 - protein, 4 aa, Artificial Sequence
  Description of Artificial Sequence: Synthetic peptide
  MOD_RES (2)..(3): Any amino acid
PXXY

SEQ ID NO: 3566 - protein, 6 aa, Artificial Sequence
  Description of Artificial Sequence: Synthetic peptide
  MOD_RES (2)..(2): Any amino acid
  MOD_RES (4)..(5): Any amino acid
LXEXXR

SEQ ID NO: 3567 - protein, 6 aa, Artificial Sequence
  Description of Artificial Sequence: Synthetic peptide
  MOD_RES (2)..(2): Any amino acid
  MOD_RES (4)..(5): Any amino acid
SXKXXK

SEQ ID NO: 3568 - protein, 4 aa, Artificial Sequence
  Description of Artificial Sequence: Synthetic peptide
  MOD_RES (3)..(3): Any amino acid
DSXT

SEQ ID NO: 3569 - protein, 5 aa, Artificial Sequence
  Description of Artificial Sequence: Synthetic peptide
  MOD_RES (3)..(4): Any amino acid
FPXXL

SEQ ID NO: 3570 - protein, 6 aa, Artificial Sequence
  Description of Artificial Sequence: Synthetic peptide
  MOD_RES (2)..(4): Any amino acid
AXXXGI

SEQ ID NO: 3571 - protein, 6 aa, Artificial Sequence
  Description of Artificial Sequence: Synthetic peptide
  MOD_RES (2)..(3): Any amino acid
DXXGDG

SEQ ID NO: 3572 - protein, 4 aa, Artificial Sequence
  Description of Artificial Sequence: Synthetic peptide
  MOD_RES (3)..(3): Any amino acid
NQXP

SEQ ID NO: 3573 - protein, 4 aa, Artificial Sequence
  Description of Artificial Sequence: Synthetic peptide
  MOD_RES (2)..(2): Any amino acid
QXPN

SEQ ID NO: 3574 - protein, 4 aa, Artificial Sequence
  Description of Artificial Sequence: Synthetic peptide
  MOD_RES (2)..(3): Any amino acid
GXXL

SEQ ID NO: 3575 - protein, 6 aa, Artificial Sequence
  Description of Artificial Sequence: Synthetic peptide
  MOD_RES (2)..(5): Any amino acid
FXXXXR

SEQ ID NO: 3576 - protein, 6 aa, Artificial Sequence
  Description of Artificial Sequence: Synthetic peptide
  MOD_RES (2)..(5): Any amino acid
EXXXXK

SEQ ID NO: 3577 - protein, 6 aa, Artificial Sequence
  Description of Artificial Sequence: Synthetic peptide
  MOD_RES (2)..(5): Any amino acid
GXXXXQ

SEQ ID NO: 3578 - protein, 5 aa, Artificial Sequence
  Description of Artificial Sequence: Synthetic peptide
TKVDK

SEQ ID NO: 3579 - protein, 6 aa, Artificial Sequence
  Description of Artificial Sequence: Synthetic peptide
  MOD_RES (2)..(5): Any amino acid
LXXXXQ

SEQ ID NO: 3580 - protein, 5 aa, Artificial Sequence
  Description of Artificial Sequence: Synthetic peptide
  MOD_RES (3)..(4): Any amino acid
NQXXN

SEQ ID NO: 3581 - protein, 6 aa, Artificial Sequence
  Description of Artificial Sequence: Synthetic peptide
  MOD_RES (2)..(2): Any amino acid
  MOD_RES (4)..(5): Any amino acid
LXEXXI

SEQ ID NO: 3582 - protein, 5 aa, Artificial Sequence
  Description of Artificial Sequence: Synthetic peptide
  MOD_RES (3)..(4): Any amino acid
VAXXN

SEQ ID NO: 3583 - protein, 6 aa, Artificial Sequence
  Description of Artificial Sequence: Synthetic peptide
  MOD_RES (2)..(5): Any amino acid
LXXXXR

SEQ ID NO: 3584 - protein, 4 aa, Artificial Sequence
  Description of Artificial Sequence: Synthetic peptide
  MOD_RES (2)..(2): Any amino acid
PXNV

SEQ ID NO: 3585 - protein, 6 aa, Artificial Sequence
  Description of Artificial Sequence: Synthetic peptide
  MOD_RES (5)..(5): Any amino acid
TQSPXS

SEQ ID NO: 3586 - protein, 6 aa, Artificial Sequence
  Description of Artificial Sequence: Synthetic peptide
  MOD_RES (2)..(4): Any amino acid
QXXXSL

SEQ ID NO: 3587 - protein, 6 aa, Artificial Sequence
  Description of Artificial Sequence: Synthetic peptide
  MOD_RES (2)..(3): Any amino acid
NXXVDK

SEQ ID NO: 3588 - protein, 6 aa, Artificial Sequence
  Description of Artificial Sequence: Synthetic peptide
  MOD_RES (2)..(5): Any amino acid
AXXXXI

SEQ ID NO: 3589 - protein, 5 aa, Artificial Sequence
  Description of Artificial Sequence: Synthetic peptide
  MOD_RES (2)..(3): Any amino acid
NXXHQ

SEQ ID NO: 3590 - protein, 6 aa, Artificial Sequence
  Description of Artificial Sequence: Synthetic peptide
  MOD_RES (3)..(4): Any amino acid
STXXDK

SEQ ID NO: 3591 - protein, 3 aa, Artificial Sequence
  Description of Artificial Sequence: Synthetic peptide
  MOD_RES (2)..(2): Any amino acid
VXC

SEQ ID NO: 3592 - protein, 5 aa, Artificial Sequence
  Description of Artificial Sequence: Synthetic peptide
  MOD_RES (4)..(4): Any amino acid
STKXD

SEQ ID NO: 3593 - protein, 6 aa, Artificial Sequence
  Description of Artificial Sequence: Synthetic peptide
  MOD_RES (2)..(4): Any amino acid
PXXXSA

SEQ ID NO: 3594 - protein, 5 aa, Artificial Sequence
  Description of Artificial Sequence: Synthetic peptide
NTKVD

SEQ ID NO: 3595 - protein, 4 aa, Artificial Sequence
  Description of Artificial Sequence: Synthetic peptide
  MOD_RES (3)..(3): Any amino acid
GVXF

SEQ ID NO: 3596 - protein, 6 aa, Artificial Sequence
  Description of Artificial Sequence: Synthetic peptide
  MOD_RES (3)..(5): Any amino acid
DLXXXE

SEQ ID NO: 3597 - protein, 5 aa, Artificial Sequence
  Description of Artificial Sequence: Synthetic peptide
  MOD_RES (2)..(2): Any amino acid
SXKVD

SEQ ID NO: 3598 - protein, 5 aa, Artificial Sequence
  Description of Artificial Sequence: Synthetic peptide
  MOD_RES (2)..(4): Any amino acid
WXXXY

SEQ ID NO: 3599 - protein, 6 aa, Artificial Sequence
  Description of Artificial Sequence: Synthetic peptide
  MOD_RES (4)..(5): Any amino acid
NTKXXK

SEQ ID NO: 3600 - protein, 6 aa, Artificial Sequence
  Description of Artificial Sequence: Synthetic peptide
  MOD_RES (2)..(5): Any amino acid
RXXXXR

SEQ ID NO: 3601 - protein, 5 aa, Artificial Sequence
  Description of Artificial Sequence: Synthetic peptide
  MOD_RES (2)..(2): Any amino acid
  MOD_RES (4)..(4): Any amino acid
RXRXG

SEQ ID NO: 3602 - protein, 6 aa, Artificial Sequence
  Description of Artificial Sequence: Synthetic peptide
  MOD_RES (3)..(5): Any amino acid
YHXXXE

SEQ ID NO: 3603 - protein, 6 aa, Artificial Sequence
  Description of Artificial Sequence: Synthetic peptide
  MOD_RES (3)..(3): Any amino acid
  MOD_RES (5)..(5): Any amino acid
SSXKXD

SEQ ID NO: 3604 - protein, 5 aa, Artificial Sequence
  Description of Artificial Sequence: Synthetic peptide
  MOD_RES (2)..(3): Any amino acid
HXXNE

SEQ ID NO: 3605 - protein, 6 aa, Artificial Sequence
  Description of Artificial Sequence: Synthetic peptide
  MOD_RES (2)..(2): Any amino acid
  MOD_RES (4)..(5): Any amino acid
LXDXXR

SEQ ID NO: 3606 - protein, 6 aa, Artificial Sequence
  Description of Artificial Sequence: Synthetic peptide
  MOD_RES (2)..(2): Any amino acid
  MOD_RES (4)..(5): Any amino acid
NXTXXE

SEQ ID NO: 3607 - protein, 6 aa, Artificial Sequence
  Description of Artificial Sequence: Synthetic peptide
  MOD_RES (2)..(2): Any amino acid
  MOD_RES (4)..(4): Any amino acid
TXVXKK

SEQ ID NO: 3608 - protein, 6 aa, Artificial Sequence
  Description of Artificial Sequence: Synthetic peptide
  MOD_RES (3)..(3): Any amino acid
  MOD_RES (5)..(5): Any amino acid
TKXDXK

SEQ ID NO: 3609 - protein, 6 aa, Artificial Sequence
  Description of Artificial Sequence: Synthetic peptide
  MOD_RES (2)..(3): Any amino acid
  MOD_RES (5)..(5): Any amino acid
RXXDXS

SEQ ID NO: 3610 - protein, 4 aa, Artificial Sequence
  Description of Artificial Sequence: Synthetic peptide
QDKE

SEQ ID NO: 3611 - protein, 4 aa, Artificial Sequence
  Description of Artificial Sequence: Synthetic peptide
  MOD_RES (2)..(3): Any amino acid
GXXF

SEQ ID NO: 3612 - protein, 5 aa, Artificial Sequence
  Description of Artificial Sequence: Synthetic peptide
  MOD_RES (4)..(4): Any amino acid
QSPXS

SEQ ID NO: 3613 - protein, 6 aa, Artificial Sequence
  Description of Artificial Sequence: Synthetic peptide
  MOD_RES (3)..(5): Any amino acid
NLXXXD

SEQ ID NO: 3614 - protein, 6 aa, Artificial Sequence
  Description of Artificial Sequence: Synthetic peptide
  MOD_RES (2)..(5): Any amino acid
YXXXXP

SEQ ID NO: 3615 - protein, 6 aa, Artificial Sequence
  Description of Artificial Sequence: Synthetic peptide
  MOD_RES (2)..(2): Any amino acid
  MOD_RES (4)..(5): Any amino acid
LXEXXK

SEQ ID NO: 3616 - protein, 5 aa, Artificial Sequence
  Description of Artificial Sequence: Synthetic peptide
  MOD_RES (2)..(2): Any amino acid
  MOD_RES (4)..(4): Any amino acid
MXIXE

SEQ ID NO: 3617 - protein, 5 aa, Artificial Sequence
  Description of Artificial Sequence: Synthetic peptide
  MOD_RES (2)..(2): Any amino acid
  MOD_RES (4)..(4): Any amino acid
GXEXF

SEQ ID NO: 3618 - protein, 6 aa, Artificial Sequence
  Description of Artificial Sequence: Synthetic peptide
  MOD_RES (2)..(2): Any amino acid
  MOD_RES (4)..(5): Any amino acid
GXTXXQ

SEQ ID NO: 3619 - protein, 6 aa, Artificial Sequence
  Description of Artificial Sequence: Synthetic peptide
  MOD_RES (2)..(3): Any amino acid
  MOD_RES (5)..(5): Any amino acid
EXXPXD

SEQ ID NO: 3620 - protein, 5 aa, Artificial Sequence
  Description of Artificial Sequence: Synthetic peptide
  MOD_RES (3)..(4): Any amino acid
MNXXD

SEQ ID NO: 3621 - protein, 4 aa, Artificial Sequence
  Description of Artificial Sequence: Synthetic peptide
  MOD_RES (3)..(3): Any amino acid
FNXN

SEQ ID NO: 3622 - protein, 4 aa, Artificial Sequence
  Description of Artificial Sequence: Synthetic peptide
  MOD_RES (2)..(2): Any amino acid
NXCN

SEQ ID NO: 3623 - protein, 6 aa, Artificial Sequence
  Description of Artificial Sequence: Synthetic peptide
  MOD_RES (2)..(5): Any amino acid
MXXXXP

SEQ ID NO: 3624 - protein, 6 aa, Artificial Sequence
  Description of Artificial Sequence: Synthetic peptide
  MOD_RES (2)..(5): Any amino acid
FXXXXD

SEQ ID NO: 3625 - protein, 6 aa, Artificial Sequence
  Description of Artificial Sequence: Synthetic peptide
  MOD_RES (2)..(4): Any amino acid
RXXXPE

SEQ ID NO: 3626 - protein, 5 aa, Artificial Sequence
  Description of Artificial Sequence: Synthetic peptide
  MOD_RES (3)..(4): Any amino acid
GSXXE

SEQ ID NO: 3627 - protein, 4 aa, Artificial Sequence
  Description of Artificial Sequence: Synthetic peptide
  MOD_RES (2)..(2): Any amino acid
NXAL

SEQ ID NO: 3628 - protein, 6 aa, Artificial Sequence
  Description of Artificial Sequence: Synthetic peptide
  MOD_RES (2)..(3): Any amino acid
  MOD_RES (5)..(5): Any amino acid
SXXVXK

SEQ ID NO: 3629 - protein, 6 aa, Artificial Sequence
  Description of Artificial Sequence: Synthetic peptide
  MOD_RES (2)..(3): Any amino acid
  MOD_RES (5)..(5): Any amino acid
RXXGXA

SEQ ID NO: 3630 - protein, 6 aa, Artificial Sequence
  Description of Artificial Sequence: Synthetic peptide
  MOD_RES (3)..(5): Any amino acid
LTXXXK

SEQ ID NO: 3631 - protein, 6 aa, Artificial Sequence
  Description of Artificial Sequence: Synthetic peptide
  MOD_RES (2)..(5): Any amino acid
IXXXXR

SEQ ID NO: 3632 - protein, 4 aa, Artificial Sequence
  Description of Artificial Sequence: Synthetic peptide
  MOD_RES (3)..(3): Any amino acid
KNXA

SEQ ID NO: 3633 - protein, 6 aa, Artificial Sequence
  Description of Artificial Sequence: Synthetic peptide
  MOD_RES (3)..(5): Any amino acid
SLXXXE

SEQ ID NO: 3634 - protein, 5 aa, Artificial Sequence
  Description of Artificial Sequence: Synthetic peptide
  MOD_RES (2)..(3): Any amino acid
AXXSQ

SEQ ID NO: 3635 - protein, 6 aa, Artificial Sequence
  Description of Artificial Sequence: Synthetic peptide
  MOD_RES (2)..(4): Any amino acid
KXXXLD

SEQ ID NO: 3636 - protein, 6 aa, Artificial Sequence
  Description of Artificial Sequence: Synthetic peptide
  MOD_RES (3)..(5): Any amino acid
VQXXXS

SEQ ID NO: 3637 - protein, 3 aa, Artificial Sequence
  Description of Artificial Sequence: Synthetic peptide
FTN

SEQ ID NO: 3638 - protein, 5 aa, Artificial Sequence
  Description of Artificial Sequence: Synthetic peptide
  MOD_RES (2)..(3): Any amino acid
QXXEG

SEQ ID NO: 3639 - protein, 3 aa, Artificial Sequence
  Description of Artificial Sequence: Synthetic peptide
GFT

SEQ ID NO: 3640 - protein, 6 aa, Artificial Sequence
  Description of Artificial Sequence: Synthetic peptide
  MOD_RES (2)..(2): Any amino acid
  MOD_RES (4)..(5): Any amino acid
GXDXXQ

SEQ ID NO: 3641 - protein, 6 aa, Artificial Sequence
  Description of Artificial Sequence: Synthetic peptide
  MOD_RES (3)..(5): Any amino acid
LTXXXR

SEQ ID NO: 3642 - protein, 4 aa, Artificial Sequence
  Description of Artificial Sequence: Synthetic peptide
  MOD_RES (2)..(2): Any amino acid
DXEG

SEQ ID NO: 3643 - protein, 6 aa, Artificial Sequence
  Description of Artificial Sequence: Synthetic peptide
  MOD_RES (3)..(5): Any amino acid
NAXXXQ

SEQ ID NO: 3644 - protein, 6 aa, Artificial Sequence
  Description of Artificial Sequence: Synthetic peptide
  MOD_RES (3)..(5): Any amino acid
QSXXXL

SEQ ID NO: 3645 - protein, 6 aa, Artificial Sequence
  Description of Artificial Sequence: Synthetic peptide
  MOD_RES (2)..(2): Any amino acid
  MOD_RES (4)..(5): Any amino acid
GXSXXA

SEQ ID NO: 3646 - protein, 6 aa, Artificial Sequence
  Description of Artificial Sequence: Synthetic peptide
  MOD_RES (3)..(5): Any amino acid
TVXXXE

SEQ ID NO: 3647 - protein, 5 aa, Artificial Sequence
  Description of Artificial Sequence: Synthetic peptide
  MOD_RES (3)..(4): Any amino acid
SKXXH

SEQ ID NO: 3648 - protein, 3 aa, Artificial Sequence
  Description of Artificial Sequence: Synthetic peptide
  MOD_RES (2)..(2): Any amino acid
CXP

SEQ ID NO: 3649 - protein, 5 aa, Artificial Sequence
  Description of Artificial Sequence: Synthetic peptide
  MOD_RES (2)..(3): Any amino acid
YXXEN

SEQ ID NO: 3650 - protein, 6 aa, Artificial Sequence
  Description of Artificial Sequence: Synthetic peptide
  MOD_RES (2)..(5): Any amino acid
YXXXXE

SEQ ID NO: 3651 - protein, 6 aa, Artificial Sequence
  Description of Artificial Sequence: Synthetic peptide
  MOD_RES (2)..(2): Any amino acid
  MOD_RES (4)..(5): Any amino acid
SXSXXA

SEQ ID NO: 3652 - protein, 5 aa, Artificial Sequence
  Description of Artificial Sequence: Synthetic peptide
  MOD_RES (2)..(3): Any amino acid
SXXGL

SEQ ID NO: 3653 - protein, 6 aa, Artificial Sequence
  Description of Artificial Sequence: Synthetic peptide
  MOD_RES (2)..(2): Any amino acid
  MOD_RES (4)..(5): Any amino acid
DXAXXQ

SEQ ID NO: 3654 - protein, 6 aa, Artificial Sequence
  Description of Artificial Sequence: Synthetic peptide
  MOD_RES (2)..(5): Any amino acid
EXXXXY

SEQ ID NO: 3655 - protein, 6 aa, Artificial Sequence
  Description of Artificial Sequence: Synthetic peptide
  MOD_RES (2)..(2): Any amino acid
  MOD_RES (4)..(5): Any amino acid
EXDXXG

SEQ ID NO: 3656 - protein, 5 aa, Artificial Sequence
  Description of Artificial Sequence: Synthetic peptide
  MOD_RES (2)..(2): Any amino acid
  MOD_RES (4)..(4): Any amino acid
RXKXG

SEQ ID NO: 3657 - protein, 6 aa, Artificial Sequence
  Description of Artificial Sequence: Synthetic peptide
  MOD_RES (2)..(2): Any amino acid
  MOD_RES (5)..(5): Any amino acid
TXVDXK

SEQ ID NO: 3658 - protein, 6 aa, Artificial Sequence
  Description of Artificial Sequence: Synthetic peptide
  MOD_RES (2)..(5): Any amino acid
GXXXXF

SEQ ID NO: 3659 - protein, 3 aa, Artificial Sequence
  Description of Artificial Sequence: Synthetic peptide
CKN

SEQ ID NO: 3660 - protein, 5 aa, Artificial Sequence
  Description of Artificial Sequence: Synthetic peptide
  MOD_RES (2)..(4): Any amino acid
YXXXE

SEQ ID NO: 3661 - protein, 6 aa, Artificial Sequence
  Description of Artificial Sequence: Synthetic peptide
  MOD_RES (2)..(5): Any amino acid
AXXXXV

SEQ ID NO: 3662 - protein, 5 aa, Artificial Sequence
  Description of Artificial Sequence: Synthetic peptide
  MOD_RES (3)..(4): Any amino acid
LSXXY

SEQ ID NO: 3663 - protein, 5 aa, Artificial Sequence
  Description of Artificial Sequence: Synthetic peptide
  MOD_RES (4)..(4): Any amino acid
TKVXK

SEQ ID NO: 3664 - protein, 5 aa, Artificial Sequence
  Description of Artificial Sequence: Synthetic peptide
  MOD_RES (2)..(3): Any amino acid
DXXRN

SEQ ID NO: 3665 - protein, 5 aa, Artificial Sequence
  Description of Artificial Sequence: Synthetic peptide
SSTKV

SEQ ID NO: 3666 - protein, 6 aa, Artificial Sequence
  Description of Artificial Sequence: Synthetic peptide
  MOD_RES (3)..(5): Any amino acid
GVXXXE

SEQ ID NO: 3667 - protein, 5 aa, Artificial Sequence
  Description of Artificial Sequence: Synthetic peptide
  MOD_RES (2)..(3): Any amino acid
EXXNS

SEQ ID NO: 3668 - protein, 5 aa, Artificial Sequence
  Description of Artificial Sequence: Synthetic peptide
  MOD_RES (2)..(2): Any amino acid
  MOD_RES (4)..(4): Any amino acid
DXDXT

SEQ ID NO: 3669 - protein, 3 aa, Artificial Sequence
  Description of Artificial Sequence: Synthetic peptide
NLY

SEQ ID NO: 3670 - protein, 4 aa, Artificial Sequence
  Description of Artificial Sequence: Synthetic peptide
  MOD_RES (2)..(2): Any amino acid
YXGD

SEQ ID NO: 3671 - protein, 6 aa, Artificial Sequence
  Description of Artificial Sequence: Synthetic peptide
  MOD_RES (2)..(3): Any amino acid
SXXWPS

SEQ ID NO: 3672 - protein, 6 aa, Artificial Sequence
  Description of Artificial Sequence: Synthetic peptide
  MOD_RES (3)..(5): Any amino acid
ELXXXE

SEQ ID NO: 3673 - protein, 6 aa, Artificial Sequence
  Description of Artificial Sequence: Synthetic peptide
  MOD_RES (2)..(2): Any amino acid
  MOD_RES (4)..(4): Any amino acid
SXTXVD

SEQ ID NO: 3674 - protein, 6 aa, Artificial Sequence
  Description of Artificial Sequence: Synthetic peptide
  MOD_RES (2)..(3): Any amino acid
TXXDKK

SEQ ID NO: 3675 - protein, 4 aa, Artificial Sequence
  Description of Artificial Sequence: Synthetic peptide
SAGT

SEQ ID NO: 3676 - protein, 4 aa, Artificial Sequence
  Description of Artificial Sequence: Synthetic peptide
  MOD_RES (3)..(3): Any amino acid
NPXE

SEQ ID NO: 3677 - protein, 6 aa, Artificial Sequence
  Description of Artificial Sequence: Synthetic peptide
  MOD_RES (3)..(3): Any amino acid
  MOD_RES (5)..(5): Any amino acid
TQXPXS

SEQ ID NO: 3678 - protein, 4 aa, Artificial Sequence
  Description of Artificial Sequence: Synthetic peptide
  MOD_RES (2)..(2): Any amino acid
DXSV

SEQ ID NO: 3679 - protein, 6 aa, Artificial Sequence
  Description of Artificial Sequence: Synthetic peptide
  MOD_RES (3)..(5): Any amino acid
GVXXXD

SEQ ID NO: 3680 - protein, 6 aa, Artificial Sequence
  Description of Artificial Sequence: Synthetic peptide
  MOD_RES (2)..(5): Any amino acid
QXXXXT

SEQ ID NO: 3681 - protein, 6 aa, Artificial Sequence
  Description of Artificial Sequence: Synthetic peptide
  MOD_RES (2)..(5): Any amino acid
RXXXXT

SEQ ID NO: 3682 - protein, 6 aa, Artificial Sequence
  Description of Artificial Sequence: Synthetic peptide
  MOD_RES (2)..(4): Any amino acid
YXXXNR

SEQ ID NO: 3683 - protein, 4 aa, Artificial Sequence
  Description of Artificial Sequence: Synthetic peptide
  MOD_RES (3)..(3): Any amino acid
NKXG

SEQ ID NO: 3684 - protein, 3 aa, Artificial Sequence
  Description of Artificial Sequence: Synthetic peptide
  MOD_RES (2)..(2): Any amino acid
CXH

SEQ ID NO: 3685 - protein, 3 aa, Artificial Sequence
  Description of Artificial Sequence: Synthetic peptide
NVM

SEQ ID NO: 3686 - protein, 4 aa, Artificial Sequence
  Description of Artificial Sequence: Synthetic peptide
  MOD_RES (2)..(3): Any amino acid
EXXI

SEQ ID NO: 3687 - protein, 5 aa, Artificial Sequence
  Description of Artificial Sequence: Synthetic peptide
  MOD_RES (3)..(3): Any amino acid
STXVD

SEQ ID NO: 3688 - protein, 5 aa, Artificial Sequence
  Description of Artificial Sequence: Synthetic peptide
KVDKK

SEQ ID NO: 3689 - protein, 4 aa, Artificial Sequence
  Description of Artificial Sequence: Synthetic peptide
  MOD_RES (3)..(3): Any amino acid
SGXW

SEQ ID NO: 3690 - protein, 6 aa, Artificial Sequence
  Description of Artificial Sequence: Synthetic peptide
  MOD_RES (3)..(4): Any amino acid
NTXXDK

SEQ ID NO: 3691 - protein, 4 aa, Artificial Sequence
  Description of Artificial Sequence: Synthetic peptide
  MOD_RES (2)..(2): Any amino acid
DXVT

SEQ ID NO: 3692 - protein, 3 aa, Artificial Sequence
  Description of Artificial Sequence: Synthetic peptide
YNN

SEQ ID NO: 3693 - protein, 6 aa, Artificial Sequence
  Description of Artificial Sequence: Synthetic peptide
  MOD_RES (2)..(2): Any amino acid
  MOD_RES (4)..(5): Any amino acid
PXTXXQ

SEQ ID NO: 3694 - protein, 5 aa, Artificial Sequence
  Description of Artificial Sequence: Synthetic peptide
  MOD_RES (2)..(3): Any amino acid
GXXGF

SEQ ID NO: 3695 - protein, 6 aa, Artificial Sequence
  Description of Artificial Sequence: Synthetic peptide
  MOD_RES (3)..(5): Any amino acid
LDXXXR

SEQ ID NO: 3696 - protein, 5 aa, Artificial Sequence
  Description of Artificial Sequence: Synthetic peptide
  MOD_RES (2)..(2): Any amino acid
NXKVD

SEQ ID NO: 3697 - protein, 6 aa, Artificial Sequence
  Description of Artificial Sequence: Synthetic peptide
  MOD_RES (3)..(5): Any amino acid
STXXXK

SEQ ID NO: 3698 - protein, 5 aa, Artificial Sequence
  Description of Artificial Sequence: Synthetic peptide
  MOD_RES (2)..(3): Any amino acid
EXXHD

SEQ ID NO: 3699 - protein, 5 aa, Artificial Sequence
  Description of Artificial Sequence: Synthetic peptide
  MOD_RES (2)..(2): Any amino acid
  MOD_RES (4)..(4): Any amino acid
DXNXY

SEQ ID NO: 3700 - protein, 6 aa, Artificial Sequence
  Description of Artificial Sequence: Synthetic peptide
  MOD_RES (2)..(3): Any amino acid
  MOD_RES (5)..(5): Any amino acid
DXXGXP

SEQ ID NO: 3701 - protein, 6 aa, Artificial Sequence
  Description of Artificial Sequence: Synthetic peptide
  MOD_RES (2)..(5): Any amino acid
SXXXXN

SEQ ID NO: 3702 - protein, 4 aa, Artificial Sequence
  Description of Artificial Sequence: Synthetic peptide
  MOD_RES (2)..(3): Any amino acid
FXXM

SEQ ID NO: 3703 - protein, 5 aa, Artificial Sequence
  Description of Artificial Sequence: Synthetic peptide
SPSSL

SEQ ID NO: 3704 - protein, 6 aa, Artificial Sequence
  Description of Artificial Sequence: Synthetic peptide
  MOD_RES (2)..(5): Any amino acid
WXXXXT

SEQ ID NO: 3705 - protein, 3 aa, Artificial Sequence
  Description of Artificial Sequence: Synthetic peptide
ESY

SEQ ID NO: 3706 - protein, 6 aa, Artificial Sequence
  Description of Artificial Sequence: Synthetic peptide
  MOD_RES (2)..(2): Any amino acid
  MOD_RES (5)..(5): Any amino acid
SXTKXD

SEQ ID NO: 3707 - protein, 5 aa, Artificial Sequence
  Description of Artificial Sequence: Synthetic peptide
  MOD_RES (2)..(3): Any amino acid
VXXKN

SEQ ID NO: 3708 - protein, 6 aa, Artificial Sequence
  Description of Artificial Sequence: Synthetic peptide
  MOD_RES (2)..(4): Any amino acid
GXXXDF

SEQ ID NO: 3709 - protein, 6 aa, Artificial Sequence
  Description of Artificial Sequence: Synthetic peptide
  MOD_RES (2)..(4): Any amino acid
RXXXTG

SEQ ID NO: 3710 - protein, 5 aa, Artificial Sequence
  Description of Artificial Sequence: Synthetic peptide
  MOD_RES (2)..(3): Any amino acid
VXXGA

SEQ ID NO: 3711 - protein, 5 aa, Artificial Sequence
  Description of Artificial Sequence: Synthetic peptide
  MOD_RES (2)..(2): Any amino acid
  MOD_RES (4)..(4): Any amino acid
QXPXS

SEQ ID NO: 3712 - protein, 6 aa, Artificial Sequence
  Description of Artificial Sequence: Synthetic peptide
  MOD_RES (2)..(5): Any amino acid
LXXXXK

SEQ ID NO: 3713 - protein, 6 aa, Artificial Sequence
  Description of Artificial Sequence: Synthetic peptide
  MOD_RES (2)..(2): Any amino acid
  MOD_RES (4)..(5): Any amino acid
SXAXXR

SEQ ID NO: 3714 - protein, 6 aa, Artificial Sequence
  Description of Artificial Sequence: Synthetic peptide
  MOD_RES (2)..(5): Any amino acid
EXXXXL

SEQ ID NO: 3715 - protein, 6 aa, Artificial Sequence
  Description of Artificial Sequence: Synthetic peptide
  MOD_RES (2)..(5): Any amino acid
YXXXXY

SEQ ID NO: 3716 - protein, 6 aa, Artificial Sequence
  Description of Artificial Sequence: Synthetic peptide
  MOD_RES (2)..(2): Any amino acid
  MOD_RES (4)..(5): Any amino acid
NXSXXD

SEQ ID NO: 3717 - protein, 5 aa, Artificial Sequence
  Description of Artificial Sequence: Synthetic peptide
  MOD_RES (3)..(4): Any amino acid
PGXXA

SEQ ID NO: 3718 - protein, 6 aa, Artificial Sequence
  Description of Artificial Sequence: Synthetic peptide
  MOD_RES (3)..(5): Any amino acid
LSXXXI

SEQ ID NO: 3719 - protein, 3 aa, Artificial Sequence
  Description of Artificial Sequence: Synthetic peptide
PNR

SEQ ID NO: 3720 - protein, 5 aa, Artificial Sequence
  Description of Artificial Sequence: Synthetic peptide
  MOD_RES (2)..(3): Any amino acid
FXXEE

SEQ ID NO: 3721 - protein, 4 aa, Artificial Sequence
  Description of Artificial Sequence: Synthetic peptide
  MOD_RES (2)..(2): Any amino acid
RXHG

SEQ ID NO: 3722 - protein, 6 aa, Artificial Sequence
  Description of Artificial Sequence: Synthetic peptide
  MOD_RES (2)..(5): Any amino acid
QXXXXL

SEQ ID NO: 3723 - protein, 6 aa, Artificial Sequence
  Description of Artificial Sequence: Synthetic peptide
  MOD_RES (2)..(4): Any amino acid
RXXXGL

SEQ ID NO: 3724 - protein, 6 aa, Artificial Sequence
  Description of Artificial Sequence: Synthetic peptide
  MOD_RES (3)..(5): Any amino acid
GLXXXE

SEQ ID NO: 3725 - protein, 5 aa, Artificial Sequence
  Description of Artificial Sequence: Synthetic peptide
  MOD_RES (2)..(3): Any amino acid
DXXRG

SEQ ID NO: 3726 - protein, 6 aa, Artificial Sequence
  Description of Artificial Sequence: Synthetic peptide
  MOD_RES (2)..(5): Any amino acid
YXXXXK

SEQ ID NO: 3727 - protein, 4 aa, Artificial Sequence
  Description of Artificial Sequence: Synthetic peptide
  MOD_RES (2)..(3): Any amino acid
FXXS

SEQ ID NO: 3728 - protein, 4 aa, Artificial Sequence
  Description of Artificial Sequence: Synthetic peptide
  MOD_RES (3)..(3): Any amino acid
TQXG

SEQ ID NO: 3729 - protein, 5 aa, Artificial Sequence
  Description of Artificial Sequence: Synthetic peptide
  MOD_RES (2)..(2): Any amino acid
  MOD_RES (4)..(4): Any amino acid
SXKXD

SEQ ID NO: 3730 - protein, 6 aa, Artificial Sequence
  Description of Artificial Sequence: Synthetic peptide
  MOD_RES (2)..(3): Any amino acid
  MOD_RES (5)..(5): Any amino acid
SXXWXS

SEQ ID NO: 3731 - protein, 3 aa, Artificial Sequence
  Description of Artificial Sequence: Synthetic peptide
VPS

SEQ ID NO: 3732 - protein, 6 aa, Artificial Sequence
  Description of Artificial Sequence: Synthetic peptide
  MOD_RES (2)..(4): Any amino acid
FXXXLT

SEQ ID NO: 3733 - protein, 6 aa, Artificial Sequence
  Description of Artificial Sequence: Synthetic peptide
  MOD_RES (4)..(5): Any amino acid
SSTXXD

SEQ ID NO: 3734 - protein, 3 aa, Artificial Sequence
  Description of Artificial Sequence: Synthetic peptide
YDY

SEQ ID NO: 3735 - protein, 6 aa, Artificial Sequence
  Description of Artificial Sequence: Synthetic peptide
  MOD_RES (3)..(5): Any amino acid
LSXXXR

SEQ ID NO: 3736 - protein, 3 aa, Artificial Sequence
  Description of Artificial Sequence: Synthetic peptide
EQF

SEQ ID NO: 3737 - protein, 5 aa, Artificial Sequence
  Description of Artificial Sequence: Synthetic peptide
  MOD_RES (2)..(2): Any amino acid
TXVDK

SEQ ID NO: 3738 - protein, 4 aa, Artificial Sequence
  Description of Artificial Sequence: Synthetic peptide
  MOD_RES (3)..(3): Any amino acid
ETXS

SEQ ID NO: 3739 - protein, 5 aa, Artificial Sequence
  Description of Artificial Sequence: Synthetic peptide
  MOD_RES (2)..(3): Any amino acid
LXXGY

SEQ ID NO: 3740 - protein, 6 aa, Artificial Sequence
  Description of Artificial Sequence: Synthetic peptide
  MOD_RES (4)..(5): Any amino acid
TKVXXK

SEQ ID NO: 3741 - protein, 5 aa, Artificial Sequence
  Description of Artificial Sequence: Synthetic peptide
  MOD_RES (3)..(4): Any amino acid
IAXXG

SEQ ID NO: 3742 - protein, 6 aa, Artificial Sequence
  Description of Artificial Sequence: Synthetic peptide
  MOD_RES (2)..(4): Any amino acid
LXXXGV

SEQ ID NO: 3743 - protein, 4 aa, Artificial Sequence
  Description of Artificial Sequence: Synthetic peptide
  MOD_RES (2)..(3): Any amino acid
YXXM

SEQ ID NO: 3744 - protein, 6 aa, Artificial Sequence
  Description of Artificial Sequence: Synthetic peptide
  MOD_RES (2)..(5): Any amino acid
MXXXXY

SEQ ID NO: 3745 - protein, 6 aa, Artificial Sequence
  Description of Artificial Sequence: Synthetic peptide
  MOD_RES (2)..(5): Any amino acid
NXXXXT

SEQ ID NO: 3746 - protein, 6 aa, Artificial Sequence
  Description of Artificial Sequence: Synthetic peptide
  MOD_RES (2)..(2): Any amino acid
  MOD_RES (4)..(5): Any amino acid
TXAXXK

SEQ ID NO: 3747 - protein, 6 aa, Artificial Sequence
  Description of Artificial Sequence: Synthetic peptide
  MOD_RES (2)..(5): Any amino acid
WXXXXK

SEQ ID NO: 3748 - protein, 4 aa, Artificial Sequence
  Description of Artificial Sequence: Synthetic peptide
  MOD_RES (2)..(2): Any amino acid
PXSS

SEQ ID NO: 3749 - protein, 5 aa, Artificial Sequence
  Description of Artificial Sequence: Synthetic peptide
  MOD_RES (3)..(3): Any amino acid
TKXDK

SEQ ID NO: 3750 - protein, 5 aa, Artificial Sequence
  Description of Artificial Sequence: Synthetic peptide
  MOD_RES (2)..(2): Any amino acid
  MOD_RES (4)..(4): Any amino acid
QXKXG

SEQ ID NO: 3751 - protein, 6 aa, Artificial Sequence
  Description of Artificial Sequence: Synthetic peptide
  MOD_RES (2)..(3): Any amino acid
SXXKVD

SEQ ID NO: 3752 - protein, 4 aa, Artificial Sequence
  Description of Artificial Sequence: Synthetic peptide
  MOD_RES (3)..(3): Any amino acid
IDXS

SEQ ID NO: 3753 - protein, 6 aa, Artificial Sequence
  Description of Artificial Sequence: Synthetic peptide
  MOD_RES (3)..(5): Any amino acid
PTXXXL

SEQ ID NO: 3754 - protein, 4 aa, Artificial Sequence
  Description of Artificial Sequence: Synthetic peptide
  MOD_RES (2)..(3): Any amino acid
FXXH

SEQ ID NO: 3755 - protein, 6 aa, Artificial Sequence
  Description of Artificial Sequence: Synthetic peptide
  MOD_RES (2)..(5): Any amino acid
LXXXXP

SEQ ID NO: 3756 - protein, 6 aa, Artificial Sequence
  Description of Artificial Sequence: Synthetic peptide
  MOD_RES (2)..(5): Any amino acid
RXXXXE

SEQ ID NO: 3757 - protein, 6 aa, Artificial Sequence
  Description of Artificial Sequence: Synthetic peptide
  MOD_RES (3)..(5): Any amino acid
QTXXXK

SEQ ID NO: 3758 - protein, 6 aa, Artificial Sequence
  Description of Artificial Sequence: Synthetic peptide
  MOD_RES (2)..(5): Any amino acid
LXXXXV

SEQ ID NO: 3759 - protein, 5 aa, Artificial Sequence
  Description of Artificial Sequence: Synthetic peptide
  MOD_RES (2)..(2): Any amino acid
  MOD_RES (4)..(4): Any amino acid
DXNXE

SEQ ID NO: 3760 - protein, 6 aa, Artificial Sequence
  Description of Artificial Sequence: Synthetic peptide
  MOD_RES (2)..(2): Any amino acid
  MOD_RES (4)..(5): Any amino acid
TXTXXE

SEQ ID NO: 3761 - protein, 6 aa, Artificial Sequence
  Description of Artificial Sequence: Synthetic peptide
  MOD_RES (3)..(4): Any amino acid
TKXXKK

SEQ ID NO: 3762 - protein, 5 aa, Artificial Sequence
  Description of Artificial Sequence: Synthetic peptide
  MOD_RES (3)..(4): Any amino acid
MNXXE

SEQ ID NO: 3763 - protein, 6 aa, Artificial Sequence
  Description of Artificial Sequence: Synthetic peptide
  MOD_RES (2)..(5): Any amino acid
EXXXXR

SEQ ID NO: 3764 - protein, 5 aa, Artificial Sequence
  Description of Artificial Sequence: Synthetic peptide
  MOD_RES (3)..(4): Any amino acid
ANXXN

SEQ ID NO: 3765 - protein, 6 aa, Artificial Sequence
  Description of Artificial Sequence: Synthetic peptide
  MOD_RES (2)..(5): Any amino acid
NXXXXW

SEQ ID NO: 3766 - protein, 6 aa, Artificial Sequence
  Description of Artificial Sequence: Synthetic peptide
  MOD_RES (2)..(3): Any amino acid
  MOD_RES (5)..(5): Any amino acid
EXXGXS

SEQ ID NO: 3767 - protein, 6 aa, Artificial Sequence
  Description of Artificial Sequence: Synthetic peptide
  MOD_RES (2)..(5): Any amino acid
QXXXXM

SEQ ID NO: 3768 - protein, 6 aa, Artificial Sequence
  Description of Artificial Sequence: Synthetic peptide
  MOD_RES (2)..(3): Any amino acid
  MOD_RES (5)..(5): Any amino acid
EXXGXS

SEQ ID NO: 3769 - protein, 6 aa, Artificial Sequence
  Description of Artificial Sequence: Synthetic peptide
  MOD_RES (2)..(5): Any amino acid
VXXXXF

SEQ ID NO: 3770 - protein, 6 aa, Artificial Sequence
  Description of Artificial Sequence: Synthetic peptide
  MOD_RES (3)..(5): Any amino acid
LSXXXK

SEQ ID NO: 3771 - protein, 3 aa, Artificial Sequence
  Description of Artificial Sequence: Synthetic peptide
MNI

SEQ ID NO: 3772 - protein, 6 aa, Artificial Sequence
  Description of Artificial Sequence: Synthetic peptide
  MOD_RES (2)..(2): Any amino acid
  MOD_RES (4)..(5): Any amino acid
GXSXXE

SEQ ID NO: 3773 - protein, 6 aa, Artificial Sequence
  Description of Artificial Sequence: Synthetic peptide
  MOD_RES (2)..(4): Any amino acid
SXXXDK

SEQ ID NO: 3774 - protein, 6 aa, Artificial Sequence
  Description of Artificial Sequence: Synthetic peptide
  MOD_RES (2)..(2): Any amino acid
  MOD_RES (4)..(5): Any amino acid
NXAXXK

SEQ ID NO: 3775 - protein, 5 aa, Artificial Sequence
  Description of Artificial Sequence: Synthetic peptide
  MOD_RES (3)..(3): Any amino acid
SPXSL

SEQ ID NO: 3776 - protein, 4 aa, Artificial Sequence
  Description of Artificial Sequence: Synthetic peptide
  MOD_RES (2)..(2): Any amino acid
QXTG

SEQ ID NO: 3777 - protein, 6 aa, Artificial Sequence
  Description of Artificial Sequence: Synthetic peptide
  MOD_RES (2)..(2): Any amino acid
  MOD_RES (4)..(5): Any amino acid
NXKXXK

SEQ ID NO: 3778 - protein, 5 aa, Artificial Sequence
  Description of Artificial Sequence: Synthetic peptide
  MOD_RES (4)..(4): Any amino acid
NTKXD

SEQ ID NO: 3779 - protein, 5 aa, Artificial Sequence
  Description of Artificial Sequence: Synthetic peptide
  MOD_RES (2)..(4): Any amino acid
YXXXF

SEQ ID NO: 3780 - protein, 6 aa, Artificial Sequence
  Description of Artificial Sequence: Synthetic peptide
  MOD_RES (3)..(5): Any amino acid
GRXXXE

SEQ ID NO: 3781 - protein, 5 aa, Artificial Sequence
  Description of Artificial Sequence: Synthetic peptide
  MOD_RES (3)..(4): Any amino acid
LPXXV

SEQ ID NO: 3782 - protein, 6 aa, Artificial Sequence
  Description of Artificial Sequence: Synthetic peptide
  MOD_RES (2)..(5): Any amino acid
EXXXXV

SEQ ID NO: 3783 - protein, 6 aa, Artificial Sequence
  Description of Artificial Sequence: Synthetic peptide
  MOD_RES (2)..(4): Any amino acid
AXXXGA

SEQ ID NO: 3784 - protein, 4 aa, Artificial Sequence
  Description of Artificial Sequence: Synthetic peptide
  MOD_RES (2)..(3): Any amino acid
RXXL

SEQ ID NO: 3785 - protein, 6 aa, Artificial Sequence
  Description of Artificial Sequence: Synthetic peptide
  MOD_RES (2)..(3): Any amino acid
  MOD_RES (5)..(5): Any amino acid
AXXGXP

SEQ ID NO: 3786 - protein, 6 aa, Artificial Sequence
  Description of Artificial Sequence: Synthetic peptide
  MOD_RES (2)..(5): Any amino acid
FXXXXK

SEQ ID NO: 3787 - protein, 3 aa, Artificial Sequence
  Description of Artificial Sequence: Synthetic peptide
QTP

SEQ ID NO: 3788 - protein, 5 aa, Artificial Sequence
  Description of Artificial Sequence: Synthetic peptide
  MOD_RES (2)..(3): Any amino acid
KXXGF

SEQ ID NO: 3789 - protein, 5 aa, Artificial Sequence
  Description of Artificial Sequence: Synthetic peptide
  MOD_RES (3)..(3): Any amino acid
NTXVD

SEQ ID NO: 3790 - protein, 6 aa, Artificial Sequence
  Description of Artificial Sequence: Synthetic peptide
  MOD_RES (3)..(4): Any amino acid
SSXXVD

SEQ ID NO: 3791 - protein, 6 aa, Artificial Sequence
  Description of Artificial Sequence: Synthetic peptide
  MOD_RES (2)..(2): Any amino acid
  MOD_RES (4)..(5): Any amino acid
GXSXXQ

SEQ ID NO: 3792 - protein, 6 aa, Artificial Sequence
  Description of Artificial Sequence: Synthetic peptide
  MOD_RES (2)..(5): Any amino acid
MXXXXL

SEQ ID NO: 3793 - protein, 4 aa, Artificial Sequence
  Description of Artificial Sequence: Synthetic peptide
  MOD_RES (2)..(2): Any amino acid
NXLP

SEQ ID NO: 3794 - protein, 5 aa, Artificial Sequence
  Description of Artificial Sequence: Synthetic peptide
  MOD_RES (2)..(3): Any amino acid
DXXSN

SEQ ID NO: 3795 - protein, 3 aa, Artificial Sequence
  Description of Artificial Sequence: Synthetic peptide
DRC

SEQ ID NO: 3796 - protein, 6 aa, Artificial Sequence
  Description of Artificial Sequence: Synthetic peptide
  MOD_RES (2)..(5): Any amino acid
EXXXXK

SEQ ID NO: 3797 - protein, 5 aa, Artificial Sequence
  Description of Artificial Sequence: Synthetic peptide
  MOD_RES (2)..(3): Any amino acid
RXXFV

SEQ ID NO: 3798 - protein, 6 aa, Artificial Sequence
  Description of Artificial Sequence: Synthetic peptide
  MOD_RES (2)..(5): Any amino acid
HXXXXR

SEQ ID NO: 3799 - protein, 5 aa, Artificial Sequence
  Description of Artificial Sequence: Synthetic peptide
  MOD_RES (2)..(3): Any amino acid
SXXDS

SEQ ID NO: 3800 - protein, 3 aa, Artificial Sequence
  Description of Artificial Sequence: Synthetic peptide
  MOD_RES (2)..(2): Any amino acid
SXW

SEQ ID NO: 3801 - protein, 6 aa, Artificial Sequence
  Description of Artificial Sequence: Synthetic peptide
  MOD_RES (2)..(2): Any amino acid
  MOD_RES (4)..(5): Any amino acid
TXSXXE

SEQ ID NO: 3802 - protein, 5 aa, Artificial Sequence
  Description of Artificial Sequence: Synthetic peptide
  MOD_RES (2)..(3): Any amino acid
EXXLP

SEQ ID NO: 3803 - protein, 6 aa, Artificial Sequence
  Description of Artificial Sequence: Synthetic peptide
  MOD_RES (2)..(5): Any amino acid
EXXXXT

SEQ ID NO: 3804 - protein, 3 aa, Artificial Sequence
  Description of Artificial Sequence: Synthetic peptide
TQA

SEQ ID NO: 3805 - protein, 6 aa, Artificial Sequence
  Description of Artificial Sequence: Synthetic peptide
  MOD_RES (2)..(5): Any amino acid
YXXXXQ

SEQ ID NO: 3806 - protein, 5 aa, Artificial Sequence
  Description of Artificial Sequence: Synthetic peptide
  MOD_RES (3)..(4): Any amino acid
RIXXN

SEQ ID NO: 3807 - protein, 4 aa, Artificial Sequence
  Description of Artificial Sequence: Synthetic peptide
  MOD_RES (2)..(2): Any amino acid
DXSQ

SEQ ID NO: 3808 - protein, 5 aa, Artificial Sequence
  Description of Artificial Sequence: Synthetic peptide
  MOD_RES (2)..(3): Any amino acid
RXXGI

SEQ ID NO: 3809 - protein, 6 aa, Artificial Sequence
  Description of Artificial Sequence: Synthetic peptide
  MOD_RES (2)..(3): Any amino acid
  MOD_RES (5)..(5): Any amino acid
KXXGXN

SEQ ID NO: 3810 - protein, 5 aa, Artificial Sequence
  Description of Artificial Sequence: Synthetic peptide
  MOD_RES (2)..(3): Any amino acid
EXXAA

SEQ ID NO: 3811 - protein, 6 aa, Artificial Sequence
  Description of Artificial Sequence: Synthetic peptide
  MOD_RES (2)..(5): Any amino acid
SXXXXY

SEQ ID NO: 3812 - protein, 4 aa, Artificial Sequence
  Description of Artificial Sequence: Synthetic peptide
  MOD_RES (2)..(3): Any amino acid
WXXP

SEQ ID NO: 3813 - protein, 6 aa, Artificial Sequence
  Description of Artificial Sequence: Synthetic peptide
  MOD_RES (2)..(4): Any amino acid
EXXXAL

SEQ ID NO: 3814 - protein, 5 aa, Artificial Sequence
  Description of Artificial Sequence: Synthetic peptide
  MOD_RES (2)..(4): Any amino acid
RXXXD

SEQ ID NO: 3815 - protein, 6 aa, Artificial Sequence
  Description of Artificial Sequence: Synthetic peptide
  MOD_RES (2)..(4): Any amino acid
AXXXGL

SEQ ID NO: 3816 - protein, 3 aa, Artificial Sequence
  Description of Artificial Sequence: Synthetic peptide
  MOD_RES (2)..(2): Any amino acid
WXG

SEQ ID NO: 3817 - protein, 6 aa, Artificial Sequence
  Description of Artificial Sequence: Synthetic peptide
  MOD_RES (2)..(2): Any amino acid
  MOD_RES (4)..(5): Any amino acid
EXSXXE

SEQ ID NO: 3818 - protein, 4 aa, Artificial Sequence
  Description of Artificial Sequence: Synthetic peptide
  MOD_RES (2)..(3): Any amino acid
RXXI

SEQ ID NO: 3819 - protein, 3 aa, Artificial Sequence
  Description of Artificial Sequence: Synthetic peptide
  MOD_RES (2)..(2): Any amino acid
KXF

SEQ ID NO: 3820 - protein, 6 aa, Artificial Sequence
  Description of Artificial Sequence: Synthetic peptide
  MOD_RES (2)..(2): Any amino acid
  MOD_RES (4)..(5): Any amino acid
TXAXXR

SEQ ID NO: 3821 - protein, 5 aa, Artificial Sequence
  Description of Artificial Sequence: Synthetic peptide
  MOD_RES (2)..(2): Any amino acid
  MOD_RES (4)..(4): Any amino acid
AXGXR

SEQ ID NO: 3822 - protein, 6 aa, Artificial Sequence
  Description of Artificial Sequence: Synthetic peptide
  MOD_RES (2)..(3): Any amino acid
  MOD_RES (5)..(5): Any amino acid
RXXGXN

SEQ ID NO: 3823 - protein, 6 aa, Artificial Sequence
  Description of Artificial Sequence: Synthetic peptide
  MOD_RES (2)..(5): Any amino acid
LXXXXI

SEQ ID NO: 3824 - protein, 5 aa, Artificial Sequence
  Description of Artificial Sequence: Synthetic peptide
  MOD_RES (3)..(4): Any amino acid
EDXXY

SEQ ID NO: 3825 - protein, 5 aa, Artificial Sequence
  Description of Artificial Sequence: Synthetic peptide
  MOD_RES (2)..(3): Any amino acid
NXXSL

SEQ ID NO: 3826 - protein, 5 aa, Artificial Sequence
  Description of Artificial Sequence: Synthetic peptide
  MOD_RES (3)..(4): Any amino acid
LNXXQ

SEQ ID NO: 3827 - protein, 5 aa, Artificial Sequence
  Description of Artificial Sequence: Synthetic peptide
  MOD_RES (2)..(2): Any amino acid
KXDKK

SEQ ID NO: 3828 - protein, 5 aa, Artificial Sequence
  Description of Artificial Sequence: Synthetic peptide
  MOD_RES (2)..(3): Any amino acid
KXXGA

SEQ ID NO: 3829 - protein, 6 aa, Artificial Sequence
  Description of Artificial Sequence: Synthetic peptide
  MOD_RES (2)..(2): Any amino acid
  MOD_RES (4)..(5): Any amino acid
TXAXXE

SEQ ID NO: 3830 - protein, 6 aa, Artificial Sequence
  Description of Artificial Sequence: Synthetic peptide
  MOD_RES (2)..(5): Any amino acid
VXXXXQ

SEQ ID NO: 3831 - protein, 3 aa, Artificial Sequence
  Description of Artificial Sequence: Synthetic peptide
DSV

SEQ ID NO: 3832 - protein, 6 aa, Artificial Sequence
  Description of Artificial Sequence: Synthetic peptide
  MOD_RES (2)..(5): Any amino acid
GXXXXQ

SEQ ID NO: 3833 - protein, 6 aa, Artificial Sequence
  Description of Artificial Sequence: Synthetic peptide
  MOD_RES (2)..(5): Any amino acid
SXXXXV

SEQ ID NO: 3834 - protein, 5 aa, Artificial Sequence
  Description of Artificial Sequence: Synthetic peptide
  MOD_RES (2)..(3): Any amino acid
NXXRN

SEQ ID NO: 3835 - protein, 5 aa, Artificial Sequence
  Description of Artificial Sequence: Synthetic peptide
  MOD_RES (2)..(4): Any amino acid
YXXXN

SEQ ID NO: 3836 - protein, 6 aa, Artificial Sequence
  Description of Artificial Sequence: Synthetic peptide
  MOD_RES (3)..(5): Any amino acid
SAXXXR

SEQ ID NO: 3837 - protein, 4 aa, Artificial Sequence
  Description of Artificial Sequence: Synthetic peptide
  MOD_RES (3)..(3): Any amino acid
EGXT

SEQ ID NO: 3838 - protein, 6 aa, Artificial Sequence
  Description of Artificial Sequence: Synthetic peptide
  MOD_RES (2)..(5): Any amino acid
LXXXXY

SEQ ID NO: 3839 - protein, 6 aa, Artificial Sequence
  Description of Artificial Sequence: Synthetic peptide
  MOD_RES (2)..(5): Any amino acid
TXXXXW

SEQ ID NO: 3840 - protein, 6 aa, Artificial Sequence
  Description of Artificial Sequence: Synthetic peptide
  MOD_RES (2)..(5): Any amino acid
EXXXXP

SEQ ID NO: 3841 - protein, 6 aa, Artificial Sequence
  Description of Artificial Sequence: Synthetic peptide
  MOD_RES (2)..(5): Any amino acid
AXXXXR

SEQ ID NO: 3842 - protein, 3 aa, Artificial Sequence
  Description of Artificial Sequence: Synthetic peptide
LGF

SEQ ID NO: 3843 - protein, 5 aa, Artificial Sequence
  Description of Artificial Sequence: Synthetic peptide
  MOD_RES (3)..(4): Any amino acid
ITXXQ

SEQ ID NO: 3844 - protein, 6 aa, Artificial Sequence
  Description of Artificial Sequence: Synthetic peptide
  MOD_RES (2)..(5): Any amino acid
TXXXXR

SEQ ID NO: 3845 - protein, 4 aa, Artificial Sequence
  Description of Artificial Sequence: Synthetic peptide
STKV

SEQ ID NO: 3846 - protein, 6 aa, Artificial Sequence
  Description of Artificial Sequence: Synthetic peptide
  MOD_RES (2)..(5): Any amino acid
IXXXXY

SEQ ID NO: 3847 - protein, 6 aa, Artificial Sequence
  Description of Artificial Sequence: Synthetic peptide
  MOD_RES (3)..(4): Any amino acid
SPXXLS

SEQ ID NO: 3848 - protein, 3 aa, Artificial Sequence
  Description of Artificial Sequence: Synthetic peptide
ALS

SEQ ID NO: 3849 - protein, 5 aa, Artificial Sequence
  Description of Artificial Sequence: Synthetic peptide
  MOD_RES (2)..(4): Any amino acid
FXXXE

SEQ ID NO: 3850 - protein, 6 aa, Artificial Sequence
  Description of Artificial Sequence: Synthetic peptide
  MOD_RES (2)..(5): Any amino acid
SXXXXQ

SEQ ID NO: 3851 - protein, 5 aa, Artificial Sequence
  Description of Artificial Sequence: Synthetic peptide
  MOD_RES (2)..(3): Any amino acid
SXXPG

SEQ ID NO: 3852 - protein, 3 aa, Artificial Sequence
  Description of Artificial Sequence: Synthetic peptide
TVA

SEQ ID NO: 3853 - protein, 4 aa, Artificial Sequence
  Description of Artificial Sequence: Synthetic peptide
  MOD_RES (2)..(2): Any amino acid
KXHG

SEQ ID NO: 3854 - protein, 5 aa, Artificial Sequence
  Description of Artificial Sequence: Synthetic peptide
  MOD_RES (2)..(2): Any amino acid
  MOD_RES (4)..(4): Any amino acid
DXPXY

SEQ ID NO: 3855 - protein, 5 aa, Artificial Sequence
  Description of Artificial Sequence: Synthetic peptide
  MOD_RES (4)..(4): Any amino acid
SSTXV

SEQ ID NO: 3856 - protein, 5 aa, Artificial Sequence
  Description of Artificial Sequence: Synthetic peptide
  MOD_RES (3)..(3): Any amino acid
SSXKV

SEQ ID NO: 3857 - protein, 6 aa, Artificial Sequence
  Description of Artificial Sequence: Synthetic peptide
  MOD_RES (3)..(5): Any amino acid
NTXXXK

SEQ ID NO: 3858 - protein, 5 aa, Artificial Sequence
  Description of Artificial Sequence: Synthetic peptide
  MOD_RES (3)..(4): Any amino acid
LPXXQ

SEQ ID NO: 3859 - protein, 6 aa, Artificial Sequence
  Description of Artificial Sequence: Synthetic peptide
  MOD_RES (2)..(2): Any amino acid
  MOD_RES (4)..(5): Any amino acid
SXTXXE

SEQ ID NO: 3860 - protein, 4 aa, Artificial Sequence
  Description of Artificial Sequence: Synthetic peptide
  MOD_RES (2)..(2): Any amino acid
PXSQ

SEQ ID NO: 3861 - protein, 6 aa, Artificial Sequence
  Description of Artificial Sequence: Synthetic peptide
  MOD_RES (2)..(5): Any amino acid
YXXXXR

SEQ ID NO: 3862 - protein, 5 aa, Artificial Sequence
  Description of Artificial Sequence: Synthetic peptide
  MOD_RES (2)..(3): Any amino acid
PXXLT

SEQ ID NO: 3863 - protein, 6 aa, Artificial Sequence
  Description of Artificial Sequence: Synthetic peptide
  MOD_RES (2)..(5): Any amino acid
WXXXXK

SEQ ID NO: 3864 - protein, 5 aa, Artificial Sequence
  Description of Artificial Sequence: Synthetic peptide
  MOD_RES (2)..(2): Any amino acid
SXTKV

SEQ ID NO: 3865 - protein, 5 aa, Artificial Sequence
  Description of Artificial Sequence: Synthetic peptide
  MOD_RES (2)..(4): Any amino acid
WXXXE

SEQ ID NO: 3866 - protein, 5 aa, Artificial Sequence
  Description of Artificial Sequence: Synthetic peptide
  MOD_RES (2)..(4): Any amino acid
YXXXH

SEQ ID NO: 3867 - protein, 6 aa, Artificial Sequence
  Description of Artificial Sequence: Synthetic peptide
  MOD_RES (3)..(5): Any amino acid
SAXXXK

SEQ ID NO: 3868 - protein, 5 aa, Artificial Sequence
  Description of Artificial Sequence: Synthetic peptide
  MOD_RES (3)..(4): Any amino acid
PVXXA

SEQ ID NO: 3869 - protein, 6 aa, Artificial Sequence
  Description of Artificial Sequence: Synthetic peptide
  MOD_RES (2)..(5): Any amino acid
LXXXXI

SEQ ID NO: 3870 - protein, 6 aa, Artificial Sequence
  Description of Artificial Sequence: Synthetic peptide
  MOD_RES (2)..(4): Any amino acid
NXXXDK

SEQ ID NO: 3871 - protein, 4 aa, Artificial Sequence
  Description of Artificial Sequence: Synthetic peptide
  MOD_RES (2)..(2): Any amino acid
SXLP

SEQ ID NO: 3872 - protein, 6 aa, Artificial Sequence
  Description of Artificial Sequence: Synthetic peptide
  MOD_RES (2)..(5): Any amino acid
IXXXXN

SEQ ID NO: 3873 - protein, 5 aa, Artificial Sequence
  Description of Artificial Sequence: Synthetic peptide
  MOD_RES (4)..(4): Any amino acid
KVDXK

SEQ ID NO: 3874 - protein, 3 aa, Artificial Sequence
  Description of Artificial Sequence: Synthetic peptide
  MOD_RES (2)..(2): Any amino acid
NXV

SEQ ID NO: 3875 - protein, 4 aa, Artificial Sequence
  Description of Artificial Sequence: Synthetic peptide
  MOD_RES (2)..(2): Any amino acid
AXGF

SEQ ID NO: 3876 - protein, 6 aa, Artificial Sequence
  Description of Artificial Sequence: Synthetic peptide
  MOD_RES (2)..(5): Any amino acid
VXXXXV

SEQ ID NO: 3877 - protein, 6 aa, Artificial Sequence
  Description of Artificial Sequence: Synthetic peptide
  MOD_RES (2)..(2): Any amino acid
  MOD_RES (4)..(5): Any amino acid
DXAXXD

SEQ ID NO: 3878 - protein, 6 aa, Artificial Sequence
  Description of Artificial Sequence: Synthetic peptide
  MOD_RES (2)..(2): Any amino acid
  MOD_RES (5)..(5): Any amino acid
DXDGXG

SEQ ID NO: 3879 - protein, 6 aa, Artificial Sequence
  Description of Artificial Sequence: Synthetic peptide
  MOD_RES (2)..(5): Any amino acid
TXXXXT

SEQ ID NO: 3880 - protein, 6 aa, Artificial Sequence
  Description of Artificial Sequence: Synthetic peptide
  MOD_RES (2)..(5): Any amino acid
QXXXXQ

SEQ ID NO: 3881 - protein, 3 aa, Artificial Sequence
  Description of Artificial Sequence: Synthetic peptide
DGR

SEQ ID NO: 3882 - protein, 6 aa, Artificial Sequence
  Description of Artificial Sequence: Synthetic peptide
  MOD_RES (2)..(5): Any amino acid
RXXXXH

SEQ ID NO: 3883 - protein, 3 aa, Artificial Sequence
  Description of Artificial Sequence: Synthetic peptide
TDV

SEQ ID NO: 3884 - protein, 5 aa, Artificial Sequence
  Description of Artificial Sequence: Synthetic peptide
  MOD_RES (2)..(3): Any amino acid
EXXGA

SEQ ID NO: 3885 - protein, 3 aa, Artificial Sequence
  Description of Artificial Sequence: Synthetic peptide
GST

SEQ ID NO: 3886 - protein, 6 aa, Artificial Sequence
  Description of Artificial Sequence: Synthetic peptide
  MOD_RES (2)..(5): Any amino acid
SXXXXR

SEQ ID NO: 3887 - protein, 5 aa, Artificial Sequence
  Description of Artificial Sequence: Synthetic peptide
  MOD_RES (3)..(4): Any amino acid
QSXXS

SEQ ID NO: 3888 - protein, 5 aa, Artificial Sequence
  Description of Artificial Sequence: Synthetic peptide
  MOD_RES (2)..(3): Any amino acid
AXXQG

SEQ ID NO: 3889 - protein, 4 aa, Artificial Sequence
  Description of Artificial Sequence: Synthetic peptide
  MOD_RES (2)..(2): Any amino acid
YXGS

SEQ ID NO: 3890 - protein, 5 aa, Artificial Sequence
  Description of Artificial Sequence: Synthetic peptide
  MOD_RES (2)..(3): Any amino acid
AXXGL

SEQ ID NO: 3891 - protein, 5 aa, Artificial Sequence
  Description of Artificial Sequence: Synthetic peptide
  MOD_RES (2)..(4): Any amino acid
QXXXW

SEQ ID NO: 3892 - protein, 6 aa, Artificial Sequence
  Description of Artificial Sequence: Synthetic peptide
  MOD_RES (2)..(5): Any amino acid
HXXXXS

SEQ ID NO: 3893 - protein, 6 aa, Artificial Sequence
  Description of Artificial Sequence: Synthetic peptide
  MOD_RES (2)..(2): Any amino acid
  MOD_RES (4)..(5): Any amino acid
TXAXXQ

SEQ ID NO: 3894 - protein, 6 aa, Artificial Sequence
  Description of Artificial Sequence: Synthetic peptide
  MOD_RES (3)..(5): Any amino acid
TAXXXE

SEQ ID NO: 3895 - protein, 6 aa, Artificial Sequence
  Description of Artificial Sequence: Synthetic peptide
  MOD_RES (2)..(5): Any amino acid
MXXXXR

SEQ ID NO: 3896 - protein, 4 aa, Artificial Sequence
  Description of Artificial Sequence: Synthetic peptide
  MOD_RES (2)..(2): Any amino acid
TXAQ

SEQ ID NO: 3897 - protein, 4 aa, Artificial Sequence
  Description of Artificial Sequence: Synthetic peptide
  MOD_RES (3)..(3): Any amino acid
ANXP

SEQ ID NO: 3898 - protein, 5 aa, Artificial Sequence
  Description of Artificial Sequence: Synthetic peptide
  MOD_RES (2)..(4): Any amino acid
YXXXM

SEQ ID NO: 3899 - protein, 6 aa, Artificial Sequence
  Description of Artificial Sequence: Synthetic peptide
  MOD_RES (2)..(5): Any amino acid
GXXXXY

SEQ ID NO: 3900 - protein, 6 aa, Artificial Sequence
  Description of Artificial Sequence: Synthetic peptide
  MOD_RES (2)..(3): Any amino acid
  MOD_RES (5)..(5): Any amino acid
NXXVXK

SEQ ID NO: 3901 - protein, 5 aa, Artificial Sequence
  Description of Artificial Sequence: Synthetic peptide
  MOD_RES (2)..(3): Any amino acid
DXXIN

SEQ ID NO: 3902 - protein, 5 aa, Artificial Sequence
  Description of Artificial Sequence: Synthetic peptide
  MOD_RES (2)..(4): Any amino acid
NXXXN

SEQ ID NO: 3903 - protein, 4 aa, Artificial Sequence
  Description of Artificial Sequence: Synthetic peptide
  MOD_RES (2)..(2): Any amino acid
RXNG

SEQ ID NO: 3904 - protein, 6 aa, Artificial Sequence
  Description of Artificial Sequence: Synthetic peptide
  MOD_RES (2)..(3): Any amino acid
  MOD_RES (5)..(5): Any amino acid
TXXDXK

SEQ ID NO: 3905 - protein, 4 aa, Artificial Sequence
  Description of Artificial Sequence: Synthetic peptide
  MOD_RES (3)..(3): Any amino acid
ARXP

SEQ ID NO: 3906 - protein, 6 aa, Artificial Sequence
  Description of Artificial Sequence: Synthetic peptide
  MOD_RES (2)..(2): Any amino acid
  MOD_RES (4)..(5): Any amino acid
SXAXXA

SEQ ID NO: 3907 - protein, 5 aa, Artificial Sequence
  Description of Artificial Sequence: Synthetic peptide
  MOD_RES (2)..(3): Any amino acid
LXXTG

SEQ ID NO: 3908 - protein, 3 aa, Artificial Sequence
  Description of Artificial Sequence: Synthetic peptide
QCG

SEQ ID NO: 3909 - protein, 5 aa, Artificial Sequence
  Description of Artificial Sequence: Synthetic peptide
  MOD_RES (3)..(4): Any amino acid
RSXXE

SEQ ID NO: 3910 - protein, 5 aa, Artificial Sequence
  Description of Artificial Sequence: Synthetic peptide
  MOD_RES (2)..(4): Any amino acid
WXXXN

SEQ ID NO: 3911 - protein, 5 aa, Artificial Sequence
  Description of Artificial Sequence: Synthetic peptide
  MOD_RES (2)..(4): Any amino acid
FXXXR

SEQ ID NO: 3912 - protein, 5 aa, Artificial Sequence
  Description of Artificial Sequence: Synthetic peptide
  MOD_RES (3)..(3): Any amino acid
KVXKK

SEQ ID NO: 3913 - protein, 4 aa, Artificial Sequence
  Description of Artificial Sequence: Synthetic peptide
  MOD_RES (2)..(2): Any amino acid
NXAQ

SEQ ID NO: 3914 - protein, 6 aa, Artificial Sequence
  Description of Artificial Sequence: Synthetic peptide
  MOD_RES (2)..(5): Any amino acid
YXXXXE

SEQ ID NO: 3915 - protein, 6 aa, Artificial Sequence
  Description of Artificial Sequence: Synthetic peptide
  MOD_RES (2)..(5): Any amino acid
DXXXXV

SEQ ID NO: 3916 - protein, 6 aa, Artificial Sequence
  Description of Artificial Sequence: Synthetic peptide
  MOD_RES (2)..(5): Any amino acid
DXXXXW

SEQ ID NO: 3917 - protein, 4 aa, Artificial Sequence
  Description of Artificial Sequence: Synthetic peptide
  MOD_RES (3)..(3): Any amino acid
DSXE

SEQ ID NO: 3918 - protein, 6 aa, Artificial Sequence
  Description of Artificial Sequence: Synthetic peptide
  MOD_RES (2)..(2): Any amino acid
  MOD_RES (4)..(5): Any amino acid
GXNXXE

SEQ ID NO: 3919 - protein, 5 aa, Artificial Sequence
  Description of Artificial Sequence: Synthetic peptide
  MOD_RES (3)..(4): Any amino acid
SQXXT

SEQ ID NO: 3920 - protein, 6 aa, Artificial Sequence
  Description of Artificial Sequence: Synthetic peptide
  MOD_RES (2)..(5): Any amino acid
RXXXXI

SEQ ID NO: 3921 - protein, 3 aa, Artificial Sequence
  Description of Artificial Sequence: Synthetic peptide
IPG

SEQ ID NO: 3922 - protein, 6 aa, Artificial Sequence
  Description of Artificial Sequence: Synthetic peptide
  MOD_RES (2)..(5): Any amino acid
DXXXXT

SEQ ID NO: 3923 - protein, 6 aa, Artificial Sequence
  Description of Artificial Sequence: Synthetic peptide
  MOD_RES (2)..(5): Any amino acid
YXXXXQ

SEQ ID NO: 3924 - protein, 4 aa, Artificial Sequence
  Description of Artificial Sequence: Synthetic peptide
  MOD_RES (2)..(2): Any amino acid
EXSG

SEQ ID NO: 3925 - protein, 4 aa, Artificial Sequence
  Description of Artificial Sequence: Synthetic peptide
SSTK

SEQ ID NO: 3926 - protein, 6 aa, Artificial Sequence
  Description of Artificial Sequence: Synthetic peptide
  MOD_RES (2)..(5): Any amino acid
RXXXXY

SEQ ID NO: 3927 - protein, 5 aa, Artificial Sequence
  Description of Artificial Sequence: Synthetic peptide
  MOD_RES (2)..(4): Any amino acid
WXXXQ

SEQ ID NO: 3928 - protein, 6 aa, Artificial Sequence
  Description of Artificial Sequence: Synthetic peptide
  MOD_RES (2)..(2): Any amino acid
  MOD_RES (4)..(5): Any amino acid
DXAXXR

SEQ ID NO: 3929 - protein, 5 aa, Artificial Sequence
  Description of Artificial Sequence: Synthetic peptide
  MOD_RES (3)..(4): Any amino acid
YQXXL

SEQ ID NO: 3930 - protein, 6 aa, Artificial Sequence
  Description of Artificial Sequence: Synthetic peptide
  MOD_RES (2)..(5): Any amino acid
YXXXXR

SEQ ID NO: 3931 - protein, 6 aa, Artificial Sequence
  Description of Artificial Sequence: Synthetic peptide
  MOD_RES (2)..(3): Any amino acid
  MOD_RES (5)..(5): Any amino acid
RXXGXP

SEQ ID NO: 3932 - protein, 5 aa, Artificial Sequence
  Description of Artificial Sequence: Synthetic peptide
  MOD_RES (3)..(4): Any amino acid
VSXXE

SEQ ID NO: 3933 - protein, 6 aa, Artificial Sequence
  Description of Artificial Sequence: Synthetic peptide
  MOD_RES (2)..(3): Any amino acid
  MOD_RES (5)..(5): Any amino acid
SXXKXD

SEQ ID NO: 3934 - protein, 5 aa, Artificial Sequence
  Description of Artificial Sequence: Synthetic peptide
  MOD_RES (2)..(3): Any amino acid
RXXGA

SEQ ID NO: 3935 - protein, 5 aa, Artificial Sequence
  Description of Artificial Sequence: Synthetic peptide
  MOD_RES (2)..(2): Any amino acid
  MOD_RES (4)..(4): Any amino acid
NXKXD

SEQ ID NO: 3936 - protein, 3 aa, Artificial Sequence
  Description of Artificial Sequence: Synthetic peptide
PTE

SEQ ID NO: 3937 - protein, 3 aa, Artificial Sequence
  Description of Artificial Sequence: Synthetic peptide
TLP

SEQ ID NO: 3938 - protein, 6 aa, Artificial Sequence
  Description of Artificial Sequence: Synthetic peptide
  MOD_RES (2)..(3): Any amino acid
  MOD_RES (5)..(5): Any amino acid
DXXGXG

SEQ ID NO: 3939 - protein, 4 aa, Artificial Sequence
  Description of Artificial Sequence: Synthetic peptide
  MOD_RES (2)..(2): Any amino acid
RXGL

SEQ ID NO: 3940 - protein, 6 aa, Artificial Sequence
  Description of Artificial Sequence: Synthetic peptide
  MOD_RES (2)..(3): Any amino acid
  MOD_RES (5)..(5): Any amino acid
KXXGXN

SEQ ID NO: 3941 - protein, 5 aa, Artificial Sequence
  Description of Artificial Sequence: Synthetic peptide
  MOD_RES (2)..(3): Any amino acid
QXXND

SEQ ID NO: 3942 - protein, 3 aa, Artificial Sequence
  Description of Artificial Sequence: Synthetic peptide
TPN

SEQ ID NO: 3943 - protein, 6 aa, Artificial Sequence
  Description of Artificial Sequence: Synthetic peptide
  MOD_RES (2)..(5): Any amino acid
PXXXXH

SEQ ID NO: 3944 - protein, 5 aa, Artificial Sequence
  Description of Artificial Sequence: Synthetic peptide
  MOD_RES (2)..(3): Any amino acid
NXXRR

SEQ ID NO: 3945 - protein, 3 aa, Artificial Sequence
  Description of Artificial Sequence: Synthetic peptide
DVQ

SEQ ID NO: 3946 - protein, 6 aa, Artificial Sequence
  Description of Artificial Sequence: Synthetic peptide
  MOD_RES (2)..(3): Any amino acid
  MOD_RES (5)..(5): Any amino acid
EXXGXP

SEQ ID NO: 3947 - protein, 4 aa, Artificial Sequence
  Description of Artificial Sequence: Synthetic peptide
  MOD_RES (3)..(3): Any amino acid
QAXG

SEQ ID NO: 3948 - protein, 5 aa, Artificial Sequence
  Description of Artificial Sequence: Synthetic peptide
  MOD_RES (3)..(4): Any amino acid
PEXXN

SEQ ID NO: 3949 - protein, 5 aa, Artificial Sequence
  Description of Artificial Sequence: Synthetic peptide
  MOD_RES (2)..(3): Any amino acid
TXXSR

SEQ ID NO: 3950 - protein, 5 aa, Artificial Sequence
  Description of Artificial Sequence: Synthetic peptide
  MOD_RES (2)..(4): Any amino acid
NXXXV

SEQ ID NO: 3951 - protein, 5 aa, Artificial Sequence
  Description of Artificial Sequence: Synthetic peptide
  MOD_RES (2)..(3): Any amino acid
SXXVS

SEQ ID NO: 3952 - protein, 6 aa, Artificial Sequence
  Description of Artificial Sequence: Synthetic peptide
  MOD_RES (2)..(5): Any amino acid
IXXXXQ

SEQ ID NO: 3953 - protein, 5 aa, Artificial Sequence
  Description of Artificial Sequence: Synthetic peptide
  MOD_RES (2)..(4): Any amino acid
WXXXR

SEQ ID NO: 3954 - protein, 5 aa, Artificial Sequence
  Description of Artificial Sequence: Synthetic peptide
  MOD_RES (2)..(2): Any amino acid
  MOD_RES (4)..(4): Any amino acid
TXVXK

SEQ ID NO: 3955 - protein, 4 aa, Artificial Sequence
  Description of Artificial Sequence: Synthetic peptide
  MOD_RES (3)..(3): Any amino acid
GDXT

SEQ ID NO: 3956 - protein, 4 aa, Artificial Sequence
  Description of Artificial Sequence: Synthetic peptide
  MOD_RES (3)..(3): Any amino acid
SAXG

SEQ ID NO: 3957 - protein, 6 aa, Artificial Sequence
  Description of Artificial Sequence: Synthetic peptide
  MOD_RES (2)..(5): Any amino acid
MXXXXK

SEQ ID NO: 3958 - protein, 5 aa, Artificial Sequence
  Description of Artificial Sequence: Synthetic peptide
  MOD_RES (3)..(4): Any amino acid
PAXXS

SEQ ID NO: 3959 - protein, 6 aa, Artificial Sequence
  Description of Artificial Sequence: Synthetic peptide
  MOD_RES (2)..(2): Any amino acid
  MOD_RES (4)..(5): Any amino acid
SXAXXE

SEQ ID NO: 3960 - protein, 5 aa, Artificial Sequence
  Description of Artificial Sequence: Synthetic peptide
  MOD_RES (2)..(3): Any amino acid
AXXAS

SEQ ID NO: 3961 - protein, 5 aa, Artificial Sequence
  Description of Artificial Sequence: Synthetic peptide
  MOD_RES (2)..(3): Any amino acid
QXXSR

SEQ ID NO: 3962 - protein, 4 aa, Artificial Sequence
  Description of Artificial Sequence: Synthetic peptide
  MOD_RES (3)..(3): Any amino acid
KPXY

SEQ ID NO: 3963 - protein, 4 aa, Artificial Sequence
  Description of Artificial Sequence: Synthetic peptide
  MOD_RES (2)..(3): Any amino acid
QXXN

SEQ ID NO: 3964 - protein, 6 aa, Artificial Sequence
  Description of Artificial Sequence: Synthetic peptide
  MOD_RES (2)..(5): Any amino acid
YXXXXR

SEQ ID NO: 3965 - protein, 6 aa, Artificial Sequence
  Description of Artificial Sequence: Synthetic peptide
  MOD_RES (2)..(4): Any amino acid
DXXXNG

SEQ ID NO: 3966 - protein, 6 aa, Artificial Sequence
  Description of Artificial Sequence: Synthetic peptide
  MOD_RES (2)..(2): Any amino acid
  MOD_RES (4)..(5): Any amino acid
GXTXXD

SEQ ID NO: 3967 - protein, 6 aa, Artificial Sequence
  Description of Artificial Sequence: Synthetic peptide
  MOD_RES (2)..(5): Any amino acid
RXXXXY

SEQ ID NO: 3968 - protein, 6 aa, Artificial Sequence
  Description of Artificial Sequence: Synthetic peptide
  MOD_RES (2)..(5): Any amino acid
FXXXXA

SEQ ID NO: 3969 - protein, 5 aa, Artificial Sequence
  Description of Artificial Sequence: Synthetic peptide
  MOD_RES (2)..(3): Any amino acid
NXXNA

SEQ ID NO: 3970 - protein, 5 aa, Artificial Sequence
  Description of Artificial Sequence: Synthetic peptide
  MOD_RES (2)..(3): Any amino acid
RXXGV

SEQ ID NO: 3971 - protein, 6 aa, Artificial Sequence
  Description of Artificial Sequence: Synthetic peptide
  MOD_RES (2)..(5): Any amino acid
GXXXXY

SEQ ID NO: 3972 - protein, 6 aa, Artificial Sequence
  Description of Artificial Sequence: Synthetic peptide
  MOD_RES (2)..(3): Any amino acid
  MOD_RES (5)..(5): Any amino acid
KXXGXP

SEQ ID NO: 3973 - protein, 5 aa, Artificial Sequence
  Description of Artificial Sequence: Synthetic peptide
  MOD_RES (2)..(3): Any amino acid
DXXFA

SEQ ID NO: 3974 - protein, 6 aa, Artificial Sequence
  Description of Artificial Sequence: Synthetic peptide
  MOD_RES (2)..(5): Any amino acid
IXXXXQ

SEQ ID NO: 3975 - protein, 5 aa, Artificial Sequence
  Description of Artificial Sequence: Synthetic peptide
  MOD_RES (3)..(4): Any amino acid
PGXXE

SEQ ID NO: 3976 - protein, 4 aa, Artificial Sequence
  Description of Artificial Sequence: Synthetic peptide
KVDK

SEQ ID NO: 3977 - protein, 6 aa, Artificial Sequence
  Description of Artificial Sequence: Synthetic peptide
  MOD_RES (2)..(5): Any amino acid
TXXXXY

SEQ ID NO: 3978 - protein, 6 aa, Artificial Sequence
  Description of Artificial Sequence: Synthetic peptide
  MOD_RES (2)..(5): Any amino acid
KXXXXY

SEQ ID NO: 3979 - protein, 3 aa, Artificial Sequence
  Description of Artificial Sequence: Synthetic peptide
  MOD_RES (2)..(2): Any amino acid
DXP

SEQ ID NO: 3980 - protein, 4 aa, Artificial Sequence
  Description of Artificial Sequence: Synthetic peptide
  MOD_RES (2)..(3): Any amino acid
DXXE

SEQ ID NO: 3981 - protein, 5 aa, Artificial Sequence
  Description of Artificial Sequence: Synthetic peptide
  MOD_RES (3)..(4): Any amino acid
AAXXG

SEQ ID NO: 3982 - protein, 3 aa, Artificial Sequence
  Description of Artificial Sequence: Synthetic peptide
SFT

SEQ ID NO: 3983 - protein, 5 aa, Artificial Sequence
  Description of Artificial Sequence: Synthetic peptide
  MOD_RES (3)..(4): Any amino acid
PEXXT

SEQ ID NO: 3984 - protein, 6 aa, Artificial Sequence
  Description of Artificial Sequence: Synthetic peptide
  MOD_RES (2)..(2): Any amino acid
  MOD_RES (4)..(5): Any amino acid
SXTXXD

SEQ ID NO: 3985 - protein, 5 aa, Artificial Sequence
  Description of Artificial Sequence: Synthetic peptide
  MOD_RES (2)..(4): Any amino acid
YXXXQ

SEQ ID NO: 3986 - protein, 6 aa, Artificial Sequence
  Description of Artificial Sequence: Synthetic peptide
  MOD_RES (2)..(3): Any amino acid
  MOD_RES (5)..(5): Any amino acid
KXXGXD

SEQ ID NO: 3987 - protein, 4 aa, Artificial Sequence
  Description of Artificial Sequence: Synthetic peptide
  MOD_RES (3)..(3): Any amino acid
GLXP

SEQ ID NO: 3988 - protein, 6 aa, Artificial Sequence
  Description of Artificial Sequence: Synthetic peptide
  MOD_RES (2)..(5): Any amino acid
GXXXXQ

SEQ ID NO: 3989 - protein, 3 aa, Artificial Sequence
  Description of Artificial Sequence: Synthetic peptide
STA

SEQ ID NO: 3990 - protein, 4 aa, Artificial Sequence
  Description of Artificial Sequence: Synthetic peptide
TKVD

SEQ ID NO: 3991 - protein, 5 aa, Artificial Sequence
  Description of Artificial Sequence: Synthetic peptide
  MOD_RES (2)..(4): Any amino acid
IXXXQ

SEQ ID NO: 3992 - protein, 6 aa, Artificial Sequence
  Description of Artificial Sequence: Synthetic peptide
  MOD_RES (2)..(5): Any amino acid
VXXXXE

SEQ ID NO: 3993 - protein, 3 aa, Artificial Sequence
  Description of Artificial Sequence: Synthetic peptide
KSR

SEQ ID NO: 3994 - protein, 5 aa, Artificial Sequence
  Description of Artificial Sequence: Synthetic peptide
  MOD_RES (2)..(4): Any amino acid
YXXXT

SEQ ID NO: 3995 - protein, 4 aa, Artificial Sequence
  Description of Artificial Sequence: Synthetic peptide
  MOD_RES (3)..(3): Any amino acid
DRXG

SEQ ID NO: 3996 - protein, 6 aa, Artificial Sequence
  Description of Artificial Sequence: Synthetic peptide
  MOD_RES (2)..(5): Any amino acid
HXXXXP

SEQ ID NO: 3997 - protein, 6 aa, Artificial Sequence
  Description of Artificial Sequence: Synthetic peptide
  MOD_RES (2)..(5): Any amino acid
MXXXXE

SEQ ID NO: 3998 - protein, 5 aa, Artificial Sequence
  Description of Artificial Sequence: Synthetic peptide
  MOD_RES (2)..(4): Any amino acid
CXXXN

SEQ ID NO: 3999 - protein, 4 aa, Artificial Sequence
  Description of Artificial Sequence: Synthetic peptide
  MOD_RES (3)..(3): Any amino acid
ERXG

SEQ ID NO: 4000 - protein, 5 aa, Artificial Sequence
  Description of Artificial Sequence: Synthetic peptide
  MOD_RES (2)..(4): Any amino acid
LXXXE

SEQ ID NO: 4001 - protein, 3 aa, Artificial Sequence
  Description of Artificial Sequence: Synthetic peptide
NSG

SEQ ID NO: 4002 - protein, 5 aa, Artificial Sequence
  Description of Artificial Sequence: Synthetic peptide
  MOD_RES (2)..(2): Any amino acid
  MOD_RES (4)..(4): Any amino acid
GXTXY

SEQ ID NO: 4003 - protein, 6 aa, Artificial Sequence
  Description of Artificial Sequence: Synthetic peptide
  MOD_RES (2)..(5): Any amino acid
TXXXXQ

SEQ ID NO: 4004 - protein, 6 aa, Artificial Sequence
  Description of Artificial Sequence: Synthetic peptide
  MOD_RES (2)..(5): Any amino acid
KXXXXY

SEQ ID NO: 4005 - protein, 5 aa, Artificial Sequence
  Description of Artificial Sequence: Synthetic peptide
  MOD_RES (2)..(4): Any amino acid
WXXXH

SEQ ID NO: 4006 - protein, 6 aa, Artificial Sequence
  Description of Artificial Sequence: Synthetic peptide
  MOD_RES (2)..(5): Any amino acid
FXXXXE

SEQ ID NO: 4007 - protein, 4 aa, Artificial Sequence
  Description of Artificial Sequence: Synthetic peptide
  MOD_RES (2)..(2): Any amino acid
DXSV

SEQ ID NO: 4008 - protein, 6 aa, Artificial Sequence
  Description of Artificial Sequence: Synthetic peptide
  MOD_RES (2)..(2): Any amino acid
  MOD_RES (4)..(5): Any amino acid
GXDXXE

SEQ ID NO: 4009 - protein, 5 aa, Artificial Sequence
  Description of Artificial Sequence: Synthetic peptide
  MOD_RES (2)..(3): Any amino acid
EXXGI

SEQ ID NO: 4010 - protein, 5 aa, Artificial Sequence
  Description of Artificial Sequence: Synthetic peptide
  MOD_RES (2)..(4): Any amino acid
YXXXM

SEQ ID NO: 4011 - protein, 4 aa, Artificial Sequence
  Description of Artificial Sequence: Synthetic peptide
  MOD_RES (2)..(2): Any amino acid
EXLP

SEQ ID NO: 4012 - protein, 6 aa, Artificial Sequence
  Description of Artificial Sequence: Synthetic peptide
  MOD_RES (2)..(5): Any amino acid
LXXXXV

SEQ ID NO: 4013 - protein, 5 aa, Artificial Sequence
  Description of Artificial Sequence: Synthetic peptide
  MOD_RES (2)..(4): Any amino acid
YXXXH

SEQ ID NO: 4014 - protein, 5 aa, Artificial Sequence
  Description of Artificial Sequence: Synthetic peptide
  MOD_RES (3)..(4): Any amino acid
STXXR

SEQ ID NO: 4015 - protein, 6 aa, Artificial Sequence
  Description of Artificial Sequence: Synthetic peptide
  MOD_RES (2)..(2): Any amino acid
  MOD_RES (4)..(5): Any amino acid
TXVXXK

SEQ ID NO: 4016 - protein, 6 aa, Artificial Sequence
  Description of Artificial Sequence: Synthetic peptide
  MOD_RES (2)..(2): Any amino acid
  MOD_RES (4)..(5): Any amino acid
KXSXXE

SEQ ID NO: 4017 - protein, 6 aa, Artificial Sequence
  Description of Artificial Sequence: Synthetic peptide
  MOD_RES (2)..(5): Any amino acid
QXXXXI

SEQ ID NO: 4018 - protein, 5 aa, Artificial Sequence
  Description of Artificial Sequence: Synthetic peptide
  MOD_RES (3)..(4): Any amino acid
RSXXL

SEQ ID NO: 4019 - protein, 5 aa, Artificial Sequence
  Description of Artificial Sequence: Synthetic peptide
  MOD_RES (2)..(4): Any amino acid
WXXXN

SEQ ID NO: 4020 - protein, 6 aa, Artificial Sequence
  Description of Artificial Sequence: Synthetic peptide
  MOD_RES (2)..(2): Any amino acid
  MOD_RES (4)..(5): Any amino acid
DXAXXE

SEQ ID NO: 4021 - protein, 5 aa, Artificial Sequence
  Description of Artificial Sequence: Synthetic peptide
  MOD_RES (2)..(4): Any amino acid
CXXXN

SEQ ID NO: 4022 - protein, 3 aa, Artificial Sequence
  Description of Artificial Sequence: Synthetic peptide
LIS

SEQ ID NO: 4023 - protein, 4 aa, Artificial Sequence
  Description of Artificial Sequence: Synthetic peptide
  MOD_RES (3)..(3): Any amino acid
LSXG

SEQ ID NO: 4024 - protein, 5 aa, Artificial Sequence
  Description of Artificial Sequence: Synthetic peptide
  MOD_RES (3)..(4): Any amino acid
LSXXQ

SEQ ID NO: 4025 - protein, 3 aa, Artificial Sequence
  Description of Artificial Sequence: Synthetic peptide
YRG

SEQ ID NO: 4026 - protein, 4 aa, Artificial Sequence
  Description of Artificial Sequence: Synthetic peptide
NTKV

SEQ ID NO: 4027 - protein, 5 aa, Artificial Sequence
  Description of Artificial Sequence: Synthetic peptide
  MOD_RES (3)..(4): Any amino acid
AQXXS

SEQ ID NO: 4028 - protein, 5 aa, Artificial Sequence
  Description of Artificial Sequence: Synthetic peptide
  MOD_RES (3)..(4): Any amino acid
ISXXE

SEQ ID NO: 4029 - protein, 6 aa, Artificial Sequence
  Description of Artificial Sequence: Synthetic peptide
  MOD_RES (3)..(5): Any amino acid
SSXXXD

SEQ ID NO: 4030 - protein, 5 aa, Artificial Sequence
  Description of Artificial Sequence: Synthetic peptide
  MOD_RES (2)..(3): Any amino acid
RXXGL

SEQ ID NO: 4031 - protein, 5 aa, Artificial Sequence
  Description of Artificial Sequence: Synthetic peptide
  MOD_RES (2)..(4): Any amino acid
HXXXW

SEQ ID NO: 4032 - protein, 6 aa, Artificial Sequence
  Description of Artificial Sequence: Synthetic peptide
  MOD_RES (2)..(5): Any amino acid
KXXXXN

SEQ ID NO: 4033 - protein, 6 aa, Artificial Sequence
  Description of Artificial Sequence: Synthetic peptide
  MOD_RES (2)..(5): Any amino acid
RXXXXQ

SEQ ID NO: 4034 - protein, 5 aa, Artificial Sequence
  Description of Artificial Sequence: Synthetic peptide
  MOD_RES (2)..(4): Any amino acid
IXXXY

SEQ ID NO: 4035 - protein, 5 aa, Artificial Sequence
  Description of Artificial Sequence: Synthetic peptide
  MOD_RES (2)..(4): Any amino acid
YXXXL

SEQ ID NO: 4036 - protein, 4 aa, Artificial Sequence
  Description of Artificial Sequence: Synthetic peptide
  MOD_RES (3)..(3): Any amino acid
DAXG

SEQ ID NO: 4037 - protein, 6 aa, Artificial Sequence
  Description of Artificial Sequence: Synthetic peptide
  MOD_RES (2)..(5): Any amino acid
NXXXXR

SEQ ID NO: 4038 - protein, 3 aa, Artificial Sequence
  Description of Artificial Sequence: Synthetic peptide
LSA

SEQ ID NO: 4039 - protein, 5 aa, Artificial Sequence
  Description of Artificial Sequence: Synthetic peptide
  MOD_RES (2)..(3): Any amino acid
AXXRH

SEQ ID NO: 4040 - protein, 4 aa, Artificial Sequence
  Description of Artificial Sequence: Synthetic peptide
  MOD_RES (3)..(3): Any amino acid
EGXP

SEQ ID NO: 4041 - protein, 3 aa, Artificial Sequence
  Description of Artificial Sequence: Synthetic peptide
AFG

SEQ ID NO: 4042 - protein, 3 aa, Artificial Sequence
  Description of Artificial Sequence: Synthetic peptide
STK

SEQ ID NO: 4043 - protein, 6 aa, Artificial Sequence
  Description of Artificial Sequence: Synthetic peptide
  MOD_RES (2)..(4): Any amino acid
EXXXSK

SEQ ID NO: 4044 - protein, 6 aa, Artificial Sequence
  Description of Artificial Sequence: Synthetic peptide
  MOD_RES (2)..(2): Any amino acid
  MOD_RES (4)..(5): Any amino acid
GXDXXA

SEQ ID NO: 4045 - protein, 5 aa, Artificial Sequence
  Description of Artificial Sequence: Synthetic peptide
  MOD_RES (2)..(4): Any amino acid
FXXXQ

SEQ ID NO: 4046 - protein, 6 aa, Artificial Sequence
  Description of Artificial Sequence: Synthetic peptide
  MOD_RES (2)..(2): Any amino acid
  MOD_RES (4)..(5): Any amino acid
GXSXXD

SEQ ID NO: 4047 - protein, 3 aa, Artificial Sequence
  Description of Artificial Sequence: Synthetic peptide
SVY

SEQ ID NO: 4048 - protein, 5 aa, Artificial Sequence
  Description of Artificial Sequence: Synthetic peptide
  MOD_RES (2)..(4): Any amino acid
SXXXH

SEQ ID NO: 4049 - protein, 4 aa, Artificial Sequence
  Description of Artificial Sequence: Synthetic peptide
  MOD_RES (3)..(3): Any amino acid
RRXG

SEQ ID NO: 4050 - protein, 5 aa, Artificial Sequence
  Description of Artificial Sequence: Synthetic peptide
  MOD_RES (2)..(4): Any amino acid
YXXXI

SEQ ID NO: 4051 - protein, 4 aa, Artificial Sequence
  Description of Artificial Sequence: Synthetic peptide
  MOD_RES (2)..(3): Any amino acid
IXXS

SEQ ID NO: 4052 - protein, 5 aa, Artificial Sequence
  Description of Artificial Sequence: Synthetic peptide
  MOD_RES (2)..(3): Any amino acid
RXXGL

SEQ ID NO: 4053 - protein, 5 aa, Artificial Sequence
  Description of Artificial Sequence: Synthetic peptide
  MOD_RES (2)..(4): Any amino acid
NXXXQ

SEQ ID NO: 4054 - protein, 4 aa, Artificial Sequence
  Description of Artificial Sequence: Synthetic peptide
  MOD_RES (2)..(2): Any amino acid
KXHG

SEQ ID NO: 4055 - protein, 5 aa, Artificial Sequence
  Description of Artificial Sequence: Synthetic peptide
  MOD_RES (2)..(4): Any amino acid
WXXXY

SEQ ID NO: 4056 - protein, 6 aa, Artificial Sequence
  Description of Artificial Sequence: Synthetic peptide
  MOD_RES (2)..(5): Any amino acid
YXXXXQ

SEQ ID NO: 4057 - protein, 6 aa, Artificial Sequence
  Description of Artificial Sequence: Synthetic peptide
  MOD_RES (2)..(5): Any amino acid
RXXXXQ

SEQ ID NO: 4058 - protein, 6 aa, Artificial Sequence
  Description of Artificial Sequence: Synthetic peptide
  MOD_RES (2)..(5): Any amino acid
RXXXXV

SEQ ID NO: 4059 - protein, 5 aa, Artificial Sequence
  Description of Artificial Sequence: Synthetic peptide
  MOD_RES (2)..(4): Any amino acid
MXXXR

SEQ ID NO: 4060 - protein, 3 aa, Artificial Sequence
  Description of Artificial Sequence: Synthetic peptide
QRG

SEQ ID NO: 4061 - protein, 5 aa, Artificial Sequence
  Description of Artificial Sequence: Synthetic peptide
  MOD_RES (2)..(3): Any amino acid
SXXAA

SEQ ID NO: 4062 - protein, 5 aa, Artificial Sequence
  Description of Artificial Sequence: Synthetic peptide
  MOD_RES (2)..(4): Any amino acid
MXXXE

SEQ ID NO: 4063 - protein, 5 aa, Artificial Sequence
  Description of Artificial Sequence: Synthetic peptide
  MOD_RES (2)..(4): Any amino acid
LXXXQ

SEQ ID NO: 4064 - protein, 5 aa, Artificial Sequence
  Description of Artificial Sequence: Synthetic peptide
  MOD_RES (2)..(4): Any amino acid
RXXXD

SEQ ID NO: 4065 - protein, 5 aa, Artificial Sequence
  Description of Artificial Sequence: Synthetic peptide
  MOD_RES (3)..(4): Any amino acid
SSXXS

SEQ ID NO: 4066 - protein, 5 aa, Artificial Sequence
  Description of Artificial Sequence: Synthetic peptide
  MOD_RES (2)..(4): Any amino acid
FXXXQ

SEQ ID NO: 4067 - protein, 5 aa, Artificial Sequence
  Description of Artificial Sequence: Synthetic peptide
  MOD_RES (3)..(4): Any amino acid
QTXXA

SEQ ID NO: 4068 - protein, 3 aa, Artificial Sequence
  Description of Artificial Sequence: Synthetic peptide
  MOD_RES (2)..(2): Any amino acid
PXN

SEQ ID NO: 4069 - protein, 6 aa, Artificial Sequence
  Description of Artificial Sequence: Synthetic peptide
  MOD_RES (2)..(5): Any amino acid
LXXXXL

SEQ ID NO: 4070 - protein, 5 aa, Artificial Sequence
  Description of Artificial Sequence: Synthetic peptide
  MOD_RES (2)..(3): Any amino acid
LXXGA

SEQ ID NO: 4071 - protein, 3 aa, Artificial Sequence
  Description of Artificial Sequence: Synthetic peptide
HPY

SEQ ID NO: 4072 - protein, 6 aa, Artificial Sequence
  Description of Artificial Sequence: Synthetic peptide
  MOD_RES (2)..(5): Any amino acid
AXXXXY

SEQ ID NO: 4073 - protein, 4 aa, Artificial Sequence
  Description of Artificial Sequence: Synthetic peptide
  MOD_RES (2)..(2): Any amino acid
KXTG

SEQ ID NO: 4074 - protein, 6 aa, Artificial Sequence
  Description of Artificial Sequence: Synthetic peptide
  MOD_RES (3)..(5): Any amino acid
SPXXXS

SEQ ID NO: 4075 - protein, 5 aa, Artificial Sequence
  Description of Artificial Sequence: Synthetic peptide
  MOD_RES (3)..(4): Any amino acid
STXXD

SEQ ID NO: 4076 - protein, 4 aa, Artificial Sequence
  Description of Artificial Sequence: Synthetic peptide
  MOD_RES (3)..(3): Any amino acid
ESXG

SEQ ID NO: 4077 - protein, 3 aa, Artificial Sequence
  Description of Artificial Sequence: Synthetic peptide
KRG

SEQ ID NO: 4078 - protein, 6 aa, Artificial Sequence
  Description of Artificial Sequence: Synthetic peptide
  MOD_RES (2)..(5): Any amino acid
LXXXXE

SEQ ID NO: 4079 - protein, 4 aa, Artificial Sequence
  Description of Artificial Sequence: Synthetic peptide
  MOD_RES (2)..(3): Any amino acid
NXXP

SEQ ID NO: 4080 - protein, 2 aa, Artificial Sequence
  Description of Artificial Sequence: Synthetic peptide
WC

SEQ ID NO: 4081 - protein, 6 aa, Artificial Sequence
  Description of Artificial Sequence: Synthetic peptide
  MOD_RES (2)..(2): Any amino acid
  MOD_RES (4)..(5): Any amino acid
DXAXXA

SEQ ID NO: 4082 - protein, 3 aa, Artificial Sequence
  Description of Artificial Sequence: Synthetic peptide
EGI

SEQ ID NO: 4083 - protein, 6 aa, Artificial Sequence
  Description of Artificial Sequence: Synthetic peptide
  MOD_RES (2)..(5): Any amino acid
EXXXXK

SEQ ID NO: 4084 - protein, 6 aa, Artificial Sequence
  Description of Artificial Sequence: Synthetic peptide
  MOD_RES (2)..(5): Any amino acid
GXXXXS

SEQ ID NO: 4085 - protein, 5 aa, Artificial Sequence
  Description of Artificial Sequence: Synthetic peptide
  MOD_RES (2)..(2): Any amino acid
  MOD_RES (4)..(4): Any amino acid
SXTXV

SEQ ID NO: 4086 - protein, 6 aa, Artificial Sequence
  Description of Artificial Sequence: Synthetic peptide
  MOD_RES (2)..(5): Any amino acid
GXXXXN

SEQ ID NO: 4087 - protein, 6 aa, Artificial Sequence
  Description of Artificial Sequence: Synthetic peptide
  MOD_RES (2)..(4): Any amino acid
TXXXKK

SEQ ID NO: 4088 - protein, 3 aa, Artificial Sequence
  Description of Artificial Sequence: Synthetic peptide
  MOD_RES (2)..(2): Any amino acid
YXY

SEQ ID NO: 4089 - protein, 4 aa, Artificial Sequence
  Description of Artificial Sequence: Synthetic peptide
  MOD_RES (2)..(2): Any amino acid
SXAE

SEQ ID NO: 4090 - protein, 4 aa, Artificial Sequence
  Description of Artificial Sequence: Synthetic peptide
  MOD_RES (2)..(2): Any amino acid
EXGF

SEQ ID NO: 4091 - protein, 3 aa, Artificial Sequence
  Description of Artificial Sequence: Synthetic peptide
LTS

SEQ ID NO: 4092 - protein, 3 aa, Artificial Sequence
  Description of Artificial Sequence: Synthetic peptide
NDG

SEQ ID NO: 4093 - protein, 6 aa, Artificial Sequence
  Description of Artificial Sequence: Synthetic peptide
  MOD_RES (2)..(5): Any amino acid
NXXXXF

SEQ ID NO: 4094 - protein, 6 aa, Artificial Sequence
  Description of Artificial Sequence: Synthetic peptide
  MOD_RES (2)..(5): Any amino acid
PXXXXQ

SEQ ID NO: 4095 - protein, 5 aa, Artificial Sequence
  Description of Artificial Sequence: Synthetic peptide
  MOD_RES (2)..(4): Any amino acid
RXXXR

SEQ ID NO: 4096 - protein, 4 aa, Artificial Sequence
  Description of Artificial Sequence: Synthetic peptide
  MOD_RES (2)..(2): Any amino acid
DXAS

SEQ ID NO: 4097 - protein, 3 aa, Artificial Sequence
  Description of Artificial Sequence: Synthetic peptide
QSP

SEQ ID NO: 4098 - protein, 4 aa, Artificial Sequence
  Description of Artificial Sequence: Synthetic peptide
  MOD_RES (3)..(3): Any amino acid
RRXG

SEQ ID NO: 4099 - protein, 3 aa, Artificial Sequence
  Description of Artificial Sequence: Synthetic peptide
LPP

SEQ ID NO: 4100 - protein, 6 aa, Artificial Sequence
  Description of Artificial Sequence: Synthetic peptide
  MOD_RES (2)..(5): Any amino acid
SXXXXD

SEQ ID NO: 4101 - protein, 6 aa, Artificial Sequence
  Description of Artificial Sequence: Synthetic peptide
  MOD_RES (2)..(5): Any amino acid
NXXXXN

SEQ ID NO: 4102 - protein, 5 aa, Artificial Sequence
  Description of Artificial Sequence: Synthetic peptide
  MOD_RES (3)..(4): Any amino acid
NAXXS

SEQ ID NO: 4103 - protein, 4 aa, Artificial Sequence
  Description of Artificial Sequence: Synthetic peptide
  MOD_RES (2)..(2): Any amino acid
RXTG

SEQ ID NO: 4104 - protein, 5 aa, Artificial Sequence
  Description of Artificial Sequence: Synthetic peptide
  MOD_RES (2)..(4): Any amino acid
YXXXF

SEQ ID NO: 4105 - protein, 3 aa, Artificial Sequence
  Description of Artificial Sequence: Synthetic peptide
VGS

SEQ ID NO: 4106 - protein, 6 aa, Artificial Sequence
  Description of Artificial Sequence: Synthetic peptide
  MOD_RES (2)..(5): Any amino acid
IXXXXI

SEQ ID NO: 4107 - protein, 5 aa, Artificial Sequence
  Description of Artificial Sequence: Synthetic peptide
  MOD_RES (2)..(3): Any amino acid
SXXVD

SEQ ID NO: 4108 - protein, 5 aa, Artificial Sequence
  Description of Artificial Sequence: Synthetic peptide
  MOD_RES (2)..(3): Any amino acid
GXXAA

SEQ ID NO: 4109 - protein, 5 aa, Artificial Sequence
  Description of Artificial Sequence: Synthetic peptide
  MOD_RES (2)..(4): Any amino acid
MXXXH

SEQ ID NO: 4110 - protein, 4 aa, Artificial Sequence
  Description of Artificial Sequence: Synthetic peptide
  MOD_RES (2)..(2): Any amino acid
PXDQ

SEQ ID NO: 4111 - protein, 2 aa, Artificial Sequence
  Description of Artificial Sequence: Synthetic peptide
CG

SEQ ID NO: 4112 - protein, 6 aa, Artificial Sequence
  Description of Artificial Sequence: Synthetic peptide
  MOD_RES (2)..(4): Any amino acid
SXXXVD

SEQ ID NO: 4113 - protein, 5 aa, Artificial Sequence
  Description of Artificial Sequence: Synthetic peptide
  MOD_RES (2)..(3): Any amino acid
AXXGL

SEQ ID NO: 4114 - protein, 4 aa, Artificial Sequence
  Description of Artificial Sequence: Synthetic peptide
  MOD_RES (3)..(3): Any amino acid
SSXK

SEQ ID NO: 4115 - protein, 4 aa, Artificial Sequence
  Description of Artificial Sequence: Synthetic peptide
  MOD_RES (2)..(2): Any amino acid
EXGG

SEQ ID NO: 4116 - protein, 6 aa, Artificial Sequence
  Description of Artificial Sequence: Synthetic peptide
  MOD_RES (2)..(5): Any amino acid
IXXXXL

SEQ ID NO: 4117 - protein, 4 aa, Artificial Sequence
  Description of Artificial Sequence: Synthetic peptide
  MOD_RES (3)..(3): Any amino acid
FPXR

SEQ ID NO: 4118 - protein, 5 aa, Artificial Sequence
  Description of Artificial Sequence: Synthetic peptide
  MOD_RES (2)..(2): Any amino acid
  MOD_RES (4)..(4): Any amino acid
KXDXK

SEQ ID NO: 4119 - protein, 6 aa, Artificial Sequence
  Description of Artificial Sequence: Synthetic peptide
  MOD_RES (2)..(5): Any amino acid
AXXXXQ

SEQ ID NO: 4120 - protein, 6 aa, Artificial Sequence
  Description of Artificial Sequence: Synthetic peptide
  MOD_RES (2)..(5): Any amino acid
VXXXXR

SEQ ID NO: 4121 - protein, 4 aa, Artificial Sequence
  Description of Artificial Sequence: Synthetic peptide
  MOD_RES (2)..(2): Any amino acid
AXGL

SEQ ID NO: 4122 - protein, 3 aa, Artificial Sequence
  Description of Artificial Sequence: Synthetic peptide
EFG

SEQ ID NO: 4123 - protein, 6 aa, Artificial Sequence
  Description of Artificial Sequence: Synthetic peptide
  MOD_RES (2)..(5): Any amino acid
LXXXXQ

SEQ ID NO: 4124 - protein, 4 aa, Artificial Sequence
  Description of Artificial Sequence: Synthetic peptide
  MOD_RES (3)..(3): Any amino acid
RSXG

SEQ ID NO: 4125 - protein, 6 aa, Artificial Sequence
  Description of Artificial Sequence: Synthetic peptide
  MOD_RES (2)..(5): Any amino acid
YXXXXS

SEQ ID NO: 4126 - protein, 5 aa, Artificial Sequence
  Description of Artificial Sequence: Synthetic peptide
  MOD_RES (2)..(3): Any amino acid
AXXAA

SEQ ID NO: 4127 - protein, 5 aa, Artificial Sequence
  Description of Artificial Sequence: Synthetic peptide
  MOD_RES (2)..(4): Any amino acid
YXXXN

SEQ ID NO: 4128 - protein, 5 aa, Artificial Sequence
  Description of Artificial Sequence: Synthetic peptide
  MOD_RES (3)..(4): Any amino acid
NEXXR

SEQ ID NO: 4129 - protein, 5 aa, Artificial Sequence
  Description of Artificial Sequence: Synthetic peptide
  MOD_RES (2)..(4): Any amino acid
YXXXY

SEQ ID NO: 4130 - protein, 5 aa, Artificial Sequence
  Description of Artificial Sequence: Synthetic peptide
  MOD_RES (2)..(4): Any amino acid
TXXXR

SEQ ID NO: 4131 - protein, 6 aa, Artificial Sequence
  Description of Artificial Sequence: Synthetic peptide
  MOD_RES (2)..(5): Any amino acid
RXXXXE

SEQ ID NO: 4132 - protein, 5 aa, Artificial Sequence
  Description of Artificial Sequence: Synthetic peptide
  MOD_RES (2)..(4): Any amino acid
LXXXV

SEQ ID NO: 4133 - protein, 4 aa, Artificial Sequence
  Description of Artificial Sequence: Synthetic peptide
  MOD_RES (3)..(3): Any amino acid
REXG

SEQ ID NO: 4134 - protein, 6 aa, Artificial Sequence
  Description of Artificial Sequence: Synthetic peptide
  MOD_RES (2)..(5): Any amino acid
VXXXXQ

SEQ ID NO: 4135 - protein, 5 aa, Artificial Sequence
  Description of Artificial Sequence: Synthetic peptide
  MOD_RES (2)..(3): Any amino acid
EXXGL

SEQ ID NO: 4136 - protein, 6 aa, Artificial Sequence
  Description of Artificial Sequence: Synthetic peptide
  MOD_RES (3)..(5): Any amino acid
TPXXXK

SEQ ID NO: 4137 - protein, 5 aa, Artificial Sequence
  Description of Artificial Sequence: Synthetic peptide
  MOD_RES (2)..(4): Any amino acid
RXXXF

SEQ ID NO: 4138 - protein, 4 aa, Artificial Sequence
  Description of Artificial Sequence: Synthetic peptide
  MOD_RES (2)..(3): Any amino acid
RXXQ

SEQ ID NO: 4139 - protein, 5 aa, Artificial Sequence
  Description of Artificial Sequence: Synthetic peptide
  MOD_RES (2)..(4): Any amino acid
FXXXQ

SEQ ID NO: 4140 - protein, 4 aa, Artificial Sequence
  Description of Artificial Sequence: Synthetic peptide
  MOD_RES (3)..(3): Any amino acid
KDXG

SEQ ID NO: 4141 - protein, 5 aa, Artificial Sequence
  Description of Artificial Sequence: Synthetic peptide
  MOD_RES (2)..(4): Any amino acid
YXXXR

SEQ ID NO: 4142 - protein, 5 aa, Artificial Sequence
  Description of Artificial Sequence: Synthetic peptide
  MOD_RES (2)..(4): Any amino acid
WXXXR

SEQ ID NO: 4143 - protein, 4 aa, Artificial Sequence
  Description of Artificial Sequence: Synthetic peptide
  MOD_RES (2)..(2): Any amino acid
KXFG

SEQ ID NO: 4144 - protein, 5 aa, Artificial Sequence
  Description of Artificial Sequence: Synthetic peptide
  MOD_RES (2)..(3): Any amino acid
KXXGV

SEQ ID NO: 4145 - protein, 4 aa, Artificial Sequence
  Description of Artificial Sequence: Synthetic peptide
  MOD_RES (3)..(3): Any amino acid
QKXG

SEQ ID NO: 4146 - protein, 6 aa, Artificial Sequence
  Description of Artificial Sequence: Synthetic peptide
  MOD_RES (2)..(5): Any amino acid
GXXXXR

SEQ ID NO: 4147 - protein, 4 aa, Artificial Sequence
  Description of Artificial Sequence: Synthetic peptide
  MOD_RES (3)..(3): Any amino acid
QEXG

SEQ ID NO: 4148 - protein, 6 aa, Artificial Sequence
  Description of Artificial Sequence: Synthetic peptide
  MOD_RES (2)..(5): Any amino acid
NXXXXK

SEQ ID NO: 4149 - protein, 5 aa, Artificial Sequence
  Description of Artificial Sequence: Synthetic peptide
  MOD_RES (2)..(4): Any amino acid
FXXXN

SEQ ID NO: 4150 - protein, 5 aa, Artificial Sequence
  Description of Artificial Sequence: Synthetic peptide
  MOD_RES (2)..(3): Any amino acid
AXXQS

SEQ ID NO: 4151 - protein, 3 aa, Artificial Sequence
  Description of Artificial Sequence: Synthetic peptide
TEA

SEQ ID NO: 4152 - protein, 5 aa, Artificial Sequence
  Description of Artificial Sequence: Synthetic peptide
  MOD_RES (2)..(4): Any amino acid
YXXXT

SEQ ID NO: 4153 - protein, 5 aa, Artificial Sequence
  Description of Artificial Sequence: Synthetic peptide
  MOD_RES (3)..(4): Any amino acid
TKXXK

SEQ ID NO: 4154 - protein, 5 aa, Artificial Sequence
  Description of Artificial Sequence: Synthetic peptide
  MOD_RES (2)..(3): Any amino acid
AXXAA

SEQ ID NO: 4155 - protein, 5 aa, Artificial Sequence
  Description of Artificial Sequence: Synthetic peptide
  MOD_RES (2)..(4): Any amino acid
EXXXF

SEQ ID NO: 4156 - protein, 5 aa, Artificial Sequence
  Description of Artificial Sequence: Synthetic peptide
  MOD_RES (3)..(4): Any amino acid
LSXXE

SEQ ID NO: 4157 - protein, 3 aa, Artificial Sequence
  Description of Artificial Sequence: Synthetic peptide
SAA

SEQ ID NO: 4158 - protein, 6 aa, Artificial Sequence
  Description of Artificial Sequence: Synthetic peptide
  MOD_RES (2)..(5): Any amino acid
DXXXXQ

SEQ ID NO: 4159 - protein, 6 aa, Artificial Sequence
  Description of Artificial Sequence: Synthetic peptide
  MOD_RES (3)..(5): Any amino acid
EAXXXQ

SEQ ID NO: 4160 - protein, 3 aa, Artificial Sequence
  Description of Artificial Sequence: Synthetic peptide
  MOD_RES (2)..(2): Any amino acid
FXN

SEQ ID NO: 4161 - protein, 4 aa, Artificial Sequence
  Description of Artificial Sequence: Synthetic peptide
  MOD_RES (2)..(2): Any amino acid
TXNG

SEQ ID NO: 4162 - protein, 5 aa, Artificial Sequence
  Description of Artificial Sequence: Synthetic peptide
  MOD_RES (2)..(4): Any amino acid
HXXXQ

SEQ ID NO: 4163 - protein, 5 aa, Artificial Sequence
  Description of Artificial Sequence: Synthetic peptide
  MOD_RES (2)..(4): Any amino acid
HXXXN

SEQ ID NO: 4164 - protein, 5 aa, Artificial Sequence
  Description of Artificial Sequence: Synthetic peptide
  MOD_RES (2)..(4): Any amino acid
NXXXR

SEQ ID NO: 4165 - protein, 3 aa, Artificial Sequence
  Description of Artificial Sequence: Synthetic peptide
NGI

SEQ ID NO: 4166 - protein, 4 aa, Artificial Sequence
  Description of Artificial Sequence: Synthetic peptide
  MOD_RES (3)..(3): Any amino acid
DKXG

SEQ ID NO: 4167 - protein, 6 aa, Artificial Sequence
  Description of Artificial Sequence: Synthetic peptide
  MOD_RES (2)..(5): Any amino acid
SXXXXY

SEQ ID NO: 4168 - protein, 5 aa, Artificial Sequence
  Description of Artificial Sequence: Synthetic peptide
  MOD_RES (3)..(4): Any amino acid
DAXXR

SEQ ID NO: 4169 - protein, 5 aa, Artificial Sequence
  Description of Artificial Sequence: Synthetic peptide
  MOD_RES (2)..(4): Any amino acid
HXXXY

SEQ ID NO: 4170 - protein, 4 aa, Artificial Sequence
  Description of Artificial Sequence: Synthetic peptide
  MOD_RES (2)..(2): Any amino acid
SXTK

SEQ ID NO: 4171 - protein, 5 aa, Artificial Sequence
  Description of Artificial Sequence: Synthetic peptide
  MOD_RES (2)..(4): Any amino acid
RXXXF

SEQ ID NO: 4172 - protein, 5 aa, Artificial Sequence
  Description of Artificial Sequence: Synthetic peptide
  MOD_RES (2)..(3): Any amino acid
SXXAQ

SEQ ID NO: 4173 - protein, 3 aa, Artificial Sequence
  Description of Artificial Sequence: Synthetic peptide
EGG

SEQ ID NO: 4174 - protein, 6 aa, Artificial Sequence
  Description of Artificial Sequence: Synthetic peptide
  MOD_RES (2)..(5): Any amino acid
LXXXXY

SEQ ID NO: 4175 - protein, 4 aa, Artificial Sequence
  Description of Artificial Sequence: Synthetic peptide
  MOD_RES (2)..(2): Any amino acid
EXTG

SEQ ID NO: 4176 - protein, 4 aa, Artificial Sequence
  Description of Artificial Sequence: Synthetic peptide
  MOD_RES (3)..(3): Any amino acid
STXV

SEQ ID NO: 4177 - protein, 5 aa, Artificial Sequence
  Description of Artificial Sequence: Synthetic peptide
  MOD_RES (2)..(4): Any amino acid
GXXXL

SEQ ID NO: 4178 - protein, 5 aa, Artificial Sequence
  Description of Artificial Sequence: Synthetic peptide
  MOD_RES (2)..(3): Any amino acid
PXXAA

SEQ ID NO: 4179 - protein, 5 aa, Artificial Sequence
  Description of Artificial Sequence: Synthetic peptide
  MOD_RES (2)..(4): Any amino acid
YXXXQ

SEQ ID NO: 4180 - protein, 6 aa, Artificial Sequence
  Description of Artificial Sequence: Synthetic peptide
  MOD_RES (2)..(5): Any amino acid
DXXXXR

SEQ ID NO: 4181 - protein, 3 aa, Artificial Sequence
  Description of Artificial Sequence: Synthetic peptide
  MOD_RES (2)..(2): Any amino acid
HXH

SEQ ID NO: 4182 - protein, 6 aa, Artificial Sequence
  Description of Artificial Sequence: Synthetic peptide
  MOD_RES (2)..(5): Any amino acid
PXXXXQ

SEQ ID NO: 4183 - protein, 6 aa, Artificial Sequence
  Description of Artificial Sequence: Synthetic peptide
  MOD_RES (2)..(2): Any amino acid
  MOD_RES (4)..(5): Any amino acid
SXEXXR

SEQ ID NO: 4184 - protein, 6 aa, Artificial Sequence
  Description of Artificial Sequence: Synthetic peptide
  MOD_RES (3)..(5): Any amino acid
SGXXXD

SEQ ID NO: 4185 - protein, 5 aa, Artificial Sequence
  Description of Artificial Sequence: Synthetic peptide
  MOD_RES (2)..(3): Any amino acid
AXXAS

SEQ ID NO: 4186 - protein, 5 aa, Artificial Sequence
  Description of Artificial Sequence: Synthetic peptide
  MOD_RES (2)..(3): Any amino acid
AXXRR

SEQ ID NO: 4187 - protein, 6 aa, Artificial Sequence
  Description of Artificial Sequence: Synthetic peptide
  MOD_RES (2)..(5): Any amino acid
NXXXXE

SEQ ID NO: 4188 - protein, 4 aa, Artificial Sequence
  Description of Artificial Sequence: Synthetic peptide
  MOD_RES (3)..(3): Any amino acid
RKXG

SEQ ID NO: 4189 - protein, 6 aa, Artificial Sequence
  Description of Artificial Sequence: Synthetic peptide
  MOD_RES (2)..(5): Any amino acid
RXXXXE

SEQ ID NO: 4190 - protein, 6 aa, Artificial Sequence
  Description of Artificial Sequence: Synthetic peptide
  MOD_RES (2)..(5): Any amino acid
LXXXXV

SEQ ID NO: 4191 - protein, 5 aa, Artificial Sequence
  Description of Artificial Sequence: Synthetic peptide
  MOD_RES (2)..(4): Any amino acid
WXXXE

SEQ ID NO: 4192 - protein, 5 aa, Artificial Sequence
  Description of Artificial Sequence: Synthetic peptide
  MOD_RES (2)..(4): Any amino acid
QXXXN

SEQ ID NO: 4193 - protein, 6 aa, Artificial Sequence
  Description of Artificial Sequence: Synthetic peptide
  MOD_RES (2)..(5): Any amino acid
YXXXXD

SEQ ID NO: 4194 - protein, 3 aa, Artificial Sequence
  Description of Artificial Sequence: Synthetic peptide
  MOD_RES (2)..(2): Any amino acid
PXW

SEQ ID NO: 4195 - protein, 5 aa, Artificial Sequence
  Description of Artificial Sequence: Synthetic peptide
  MOD_RES (2)..(3): Any amino acid
AXXQD

SEQ ID NO: 4196 - protein, 3 aa, Artificial Sequence
  Description of Artificial Sequence: Synthetic peptide
WPS

SEQ ID NO: 4197 - protein, 5 aa, Artificial Sequence
  Description of Artificial Sequence: Synthetic peptide
  MOD_RES (2)..(4): Any amino acid
QXXXR

SEQ ID NO: 4198 - protein, 6 aa, Artificial Sequence
  Description of Artificial Sequence: Synthetic peptide
  MOD_RES (2)..(5): Any amino acid
QXXXXL

SEQ ID NO: 4199 - protein, 5 aa, Artificial Sequence
  Description of Artificial Sequence: Synthetic peptide
  MOD_RES (2)..(4): Any amino acid
PXXXN

SEQ ID NO: 4200 - protein, 6 aa, Artificial Sequence
  Description of Artificial Sequence: Synthetic peptide
  MOD_RES (2)..(2): Any amino acid
  MOD_RES (4)..(5): Any amino acid
GXTXXE

SEQ ID NO: 4201 - protein, 5 aa, Artificial Sequence
  Description of Artificial Sequence: Synthetic peptide
  MOD_RES (2)..(3): Any amino acid
AXXRD

SEQ ID NO: 4202 - protein, 6 aa, Artificial Sequence
  Description of Artificial Sequence: Synthetic peptide
  MOD_RES (2)..(5): Any amino acid
IXXXXE

SEQ ID NO: 4203 - protein, 5 aa, Artificial Sequence
  Description of Artificial Sequence: Synthetic peptide
  MOD_RES (3)..(4): Any amino acid
LTXXE

SEQ ID NO: 4204 - protein, 5 aa, Artificial Sequence
  Description of Artificial Sequence: Synthetic peptide
  MOD_RES (2)..(3): Any amino acid
DXXRR

SEQ ID NO: 4205 - protein, 6 aa, Artificial Sequence
  Description of Artificial Sequence: Synthetic peptide
  MOD_RES (3)..(5): Any amino acid
RAXXXR

SEQ ID NO: 4206 - protein, 4 aa, Artificial Sequence
  Description of Artificial Sequence: Synthetic peptide
  MOD_RES (2)..(2): Any amino acid
EXFG

SEQ ID NO: 4207 - protein, 4 aa, Artificial Sequence
  Description of Artificial Sequence: Synthetic peptide
  MOD_RES (2)..(3): Any amino acid
HXXR

SEQ ID NO: 4208 - protein, 5 aa, Artificial Sequence
  Description of Artificial Sequence: Synthetic peptide
  MOD_RES (2)..(4): Any amino acid
EXXXY

SEQ ID NO: 4209 - protein, 4 aa, Artificial Sequence
  Description of Artificial Sequence: Synthetic peptide
  MOD_RES (2)..(2): Any amino acid
SXQE

SEQ ID NO: 4210 - protein, 6 aa, Artificial Sequence
  Description of Artificial Sequence: Synthetic peptide
  MOD_RES (2)..(5): Any amino acid
GXXXXR

SEQ ID NO: 4211 - protein, 4 aa, Artificial Sequence
  Description of Artificial Sequence: Synthetic peptide
  MOD_RES (2)..(3): Any amino acid
KXXW

SEQ ID NO: 4212 - protein, 5 aa, Artificial Sequence
  Description of Artificial Sequence: Synthetic peptide
  MOD_RES (2)..(4): Any amino acid
QXXXQ

SEQ ID NO: 4213 - protein, 5 aa, Artificial Sequence
  Description of Artificial Sequence: Synthetic peptide
  MOD_RES (3)..(4): Any amino acid
QAXXS

SEQ ID NO: 4214 - protein, 6 aa, Artificial Sequence
  Description of Artificial Sequence: Synthetic peptide
  MOD_RES (2)..(5): Any amino acid
EXXXXY

SEQ ID NO: 4215 - protein, 4 aa, Artificial Sequence
  Description of Artificial Sequence: Synthetic peptide
  MOD_RES (2)..(2): Any amino acid
SXSE

SEQ ID NO: 4216 - protein, 5 aa, Artificial Sequence
  Description of Artificial Sequence: Synthetic peptide
  MOD_RES (2)..(4): Any amino acid
IXXXN

SEQ ID NO: 4217 - protein, 3 aa, Artificial Sequence
  Description of Artificial Sequence: Synthetic peptide
ADG

SEQ ID NO: 4218 - protein, 5 aa, Artificial Sequence
  Description of Artificial Sequence: Synthetic peptide
  MOD_RES (2)..(4): Any amino acid
FXXXC

SEQ ID NO: 4219 - protein, 5 aa, Artificial Sequence
  Description of Artificial Sequence: Synthetic peptide
  MOD_RES (2)..(4): Any amino acid
FXXXH

SEQ ID NO: 4220 - protein, 6 aa, Artificial Sequence
  Description of Artificial Sequence: Synthetic peptide
  MOD_RES (2)..(5): Any amino acid
NXXXXS

SEQ ID NO: 4221 - protein, 4 aa, Artificial Sequence
  Description of Artificial Sequence: Synthetic peptide
  MOD_RES (3)..(3): Any amino acid
ISXE

SEQ ID NO: 4222 - protein, 6 aa, Artificial Sequence
  Description of Artificial Sequence: Synthetic peptide
  MOD_RES (2)..(5): Any amino acid
TXXXXE

SEQ ID NO: 4223 - protein, 5 aa, Artificial Sequence
  Description of Artificial Sequence: Synthetic peptide
  MOD_RES (2)..(4): Any amino acid
YXXXL

SEQ ID NO: 4224 - protein, 5 aa, Artificial Sequence
  Description of Artificial Sequence: Synthetic peptide
  MOD_RES (2)..(4): Any amino acid
IXXXT

SEQ ID NO: 4225 - protein, 5 aa, Artificial Sequence
  Description of Artificial Sequence: Synthetic peptide
  MOD_RES (2)..(4): Any amino acid
QXXXD

SEQ ID NO: 4226 - protein, 4 aa, Artificial Sequence
  Description of Artificial Sequence: Synthetic peptide
  MOD_RES (2)..(2): Any amino acid
KXDK

SEQ ID NO: 4227 - protein, 4 aa, Artificial Sequence
  Description of Artificial Sequence: Synthetic peptide
  MOD_RES (2)..(2): Any amino acid
SXKV

SEQ ID NO: 4228 - protein, 5 aa, Artificial Sequence
  Description of Artificial Sequence: Synthetic peptide
  MOD_RES (2)..(3): Any amino acid
QXXAA

SEQ ID NO: 4229 - protein, 5 aa, Artificial Sequence
  Description of Artificial Sequence: Synthetic peptide
  MOD_RES (2)..(3): Any amino acid
EXXRL

SEQ ID NO: 4230 - protein, 4 aa, Artificial Sequence
  Description of Artificial Sequence: Synthetic peptide
  MOD_RES (2)..(3): Any amino acid
PXXH

SEQ ID NO: 4231 - protein, 5 aa, Artificial Sequence
  Description of Artificial Sequence: Synthetic peptide
  MOD_RES (2)..(3): Any amino acid
SXXQA

SEQ ID NO: 4232 - protein, 5 aa, Artificial Sequence
  Description of Artificial Sequence: Synthetic peptide
  MOD_RES (3)..(4): Any amino acid
LSXXE

SEQ ID NO: 4233 - protein, 6 aa, Artificial Sequence
  Description of Artificial Sequence: Synthetic peptide
  MOD_RES (3)..(5): Any amino acid
TKXXXK

SEQ ID NO: 4234 - protein, 6 aa, Artificial Sequence
  Description of Artificial Sequence: Synthetic peptide
  MOD_RES (2)..(5): Any amino acid
QXXXXE

SEQ ID NO: 4235 - protein, 5 aa, Artificial Sequence
  Description of Artificial Sequence: Synthetic peptide
  MOD_RES (2)..(4): Any amino acid
YXXXR

SEQ ID NO: 4236 - protein, 3 aa, Artificial Sequence
  Description of Artificial Sequence: Synthetic peptide
  MOD_RES (2)..(2): Any amino acid
SXY

SEQ ID NO: 4237 - protein, 4 aa, Artificial Sequence
  Description of Artificial Sequence: Synthetic peptide
  MOD_RES (2)..(2): Any amino acid
TXAE

SEQ ID NO: 4238 - protein, 6 aa, Artificial Sequence
  Description of Artificial Sequence: Synthetic peptide
  MOD_RES (2)..(5): Any amino acid
AXXXXI

SEQ ID NO: 4239 - protein, 4 aa, Artificial Sequence
  Description of Artificial Sequence: Synthetic peptide
  MOD_RES (2)..(3): Any amino acid
NXXE

SEQ ID NO: 4240 - protein, 3 aa, Artificial Sequence
  Description of Artificial Sequence: Synthetic peptide
YPS

SEQ ID NO: 4241 - protein, 5 aa, Artificial Sequence
  Description of Artificial Sequence: Synthetic peptide
  MOD_RES (2)..(4): Any amino acid
YXXXS

SEQ ID NO: 4242 - protein, 5 aa, Artificial Sequence
  Description of Artificial Sequence: Synthetic peptide
  MOD_RES (2)..(4): Any amino acid
NXXXQ

SEQ ID NO: 4243 - protein, 6 aa, Artificial Sequence
  Description of Artificial Sequence: Synthetic peptide
  MOD_RES (2)..(5): Any amino acid
EXXXXR

SEQ ID NO: 4244 - protein, 6 aa, Artificial Sequence
  Description of Artificial Sequence: Synthetic peptide
  MOD_RES (2)..(4): Any amino acid
RXXXAE

SEQ ID NO: 4245 - protein, 5 aa, Artificial Sequence
  Description of Artificial Sequence: Synthetic peptide
  MOD_RES (3)..(4): Any amino acid
AEXXS

SEQ ID NO: 4246 - protein, 4 aa, Artificial Sequence
  Description of Artificial Sequence: Synthetic peptide
  MOD_RES (2)..(3): Any amino acid
HXXL

SEQ ID NO: 4247 - protein, 6 aa, Artificial Sequence
  Description of Artificial Sequence: Synthetic peptide
  MOD_RES (2)..(5): Any amino acid
GXXXXE

SEQ ID NO: 4248 - protein, 5 aa, Artificial Sequence
  Description of Artificial Sequence: Synthetic peptide
  MOD_RES (2)..(4): Any amino acid
HXXXR

SEQ ID NO: 4249 - protein, 5 aa, Artificial Sequence
  Description of Artificial Sequence: Synthetic peptide
  MOD_RES (2)..(3): Any amino acid
EXXRR

SEQ ID NO: 4250 - protein, 5 aa, Artificial Sequence
  Description of Artificial Sequence: Synthetic peptide
  MOD_RES (3)..(4): Any amino acid
ARXXQ

SEQ ID NO: 4251 - protein, 5 aa, Artificial Sequence
  Description of Artificial Sequence: Synthetic peptide
  MOD_RES (2)..(4): Any amino acid
QXXXG

SEQ ID NO: 4252 - protein, 5 aa, Artificial Sequence
  Description of Artificial Sequence: Synthetic peptide
  MOD_RES (2)..(4): Any amino acid
LXXXH

SEQ ID NO: 4253 - protein, 5 aa, Artificial Sequence
  Description of Artificial Sequence: Synthetic peptide
  MOD_RES (3)..(4): Any amino acid
SPXXL

SEQ ID NO: 4254 - protein, 4 aa, Artificial Sequence
  Description of Artificial Sequence: Synthetic peptide
  MOD_RES (2)..(2): Any amino acid
NXED

SEQ ID NO: 4255 - protein, 5 aa, Artificial Sequence
  Description of Artificial Sequence: Synthetic peptide
  MOD_RES (2)..(4): Any amino acid
YXXXR

SEQ ID NO: 4256 - protein, 5 aa, Artificial Sequence
  Description of Artificial Sequence: Synthetic peptide
  MOD_RES (2)..(4): Any amino acid
QXXXR

SEQ ID NO: 4257 - protein, 4 aa, Artificial Sequence
  Description of Artificial Sequence: Synthetic peptide
  MOD_RES (2)..(3): Any amino acid
IXXE

SEQ ID NO: 4258 - protein, 6 aa, Artificial Sequence
  Description of Artificial Sequence: Synthetic peptide
  MOD_RES (2)..(5): Any amino acid
AXXXXV

SEQ ID NO: 4259 - protein, 6 aa, Artificial Sequence
  Description of Artificial Sequence: Synthetic peptide
  MOD_RES (2)..(5): Any amino acid
SXXXXQ

SEQ ID NO: 4260 - protein, 5 aa, Artificial Sequence
  Description of Artificial Sequence: Synthetic peptide
  MOD_RES (2)..(3): Any amino acid
TXXDK

SEQ ID NO: 4261 - protein, 5 aa, Artificial Sequence
  Description of Artificial Sequence: Synthetic peptide
  MOD_RES (2)..(3): Any amino acid
KXXDG

SEQ ID NO: 4262 - protein, 5 aa, Artificial Sequence
  Description of Artificial Sequence: Synthetic peptide
  MOD_RES (2)..(4): Any amino acid
WXXXT

SEQ ID NO: 4263 - protein, 6 aa, Artificial Sequence
  Description of Artificial Sequence: Synthetic peptide
  MOD_RES (2)..(5): Any amino acid
RXXXXR

SEQ ID NO: 4264 - protein, 5 aa, Artificial Sequence
  Description of Artificial Sequence: Synthetic peptide
  MOD_RES (2)..(3): Any amino acid
EXXGL

SEQ ID NO: 4265 - protein, 6 aa, Artificial Sequence
  Description of Artificial Sequence: Synthetic peptide
  MOD_RES (2)..(5): Any amino acid
DXXXXQ

SEQ ID NO: 4266 - protein, 5 aa, Artificial Sequence
  Description of Artificial Sequence: Synthetic peptide
  MOD_RES (2)..(4): Any amino acid
FXXXR

SEQ ID NO: 4267 - protein, 4 aa, Artificial Sequence
  Description of Artificial Sequence: Synthetic peptide
  MOD_RES (3)..(3): Any amino acid
TKXD

SEQ ID NO: 4268 - protein, 5 aa, Artificial Sequence
  Description of Artificial Sequence: Synthetic peptide
  MOD_RES (2)..(4): Any amino acid
LXXXE

SEQ ID NO: 4269 - protein, 5 aa, Artificial Sequence
  Description of Artificial Sequence: Synthetic peptide
  MOD_RES (2)..(4): Any amino acid
RXXXR

SEQ ID NO: 4270 - protein, 5 aa, Artificial Sequence
  Description of Artificial Sequence: Synthetic peptide
  MOD_RES (2)..(4): Any amino acid
FXXXS

SEQ ID NO: 4271 - protein, 4 aa, Artificial Sequence
  Description of Artificial Sequence: Synthetic peptide
  MOD_RES (2)..(3): Any amino acid
EXXT

SEQ ID NO: 4272 - protein, 5 aa, Artificial Sequence
  Description of Artificial Sequence: Synthetic peptide
  MOD_RES (2)..(4): Any amino acid
IXXXR

SEQ ID NO: 4273 - protein, 5 aa, Artificial Sequence
  Description of Artificial Sequence: Synthetic peptide
  MOD_RES (2)..(4): Any amino acid
FXXXY

SEQ ID NO: 4274 - protein, 6 aa, Artificial Sequence
  Description of Artificial Sequence: Synthetic peptide
  MOD_RES (2)..(5): Any amino acid
YXXXXK

SEQ ID NO: 4275 - protein, 5 aa, Artificial Sequence
  Description of Artificial Sequence: Synthetic peptide
  MOD_RES (2)..(4): Any amino acid
QXXXQ

SEQ ID NO: 4276 - protein, 6 aa, Artificial Sequence
  Description of Artificial Sequence: Synthetic peptide
  MOD_RES (2)..(5): Any amino acid
RXXXXL

SEQ ID NO: 4277 - protein, 6 aa, Artificial Sequence
  Description of Artificial Sequence: Synthetic peptide
  MOD_RES (2)..(5): Any amino acid
NXXXXQ

SEQ ID NO: 4278 - protein, 5 aa, Artificial Sequence
  Description of Artificial Sequence: Synthetic peptide
  MOD_RES (2)..(3): Any amino acid
AXXAQ

SEQ ID NO: 4279 - protein, 3 aa, Artificial Sequence
  Description of Artificial Sequence: Synthetic peptide
  MOD_RES (2)..(2): Any amino acid
SXM

SEQ ID NO: 4280 - protein, 3 aa, Artificial Sequence
  Description of Artificial Sequence: Synthetic peptide
VGG

SEQ ID NO: 4281 - protein, 5 aa, Artificial Sequence
  Description of Artificial Sequence: Synthetic peptide
  MOD_RES (2)..(4): Any amino acid
MXXXN

SEQ ID NO: 4282 - protein, 6 aa, Artificial Sequence
  Description of Artificial Sequence: Synthetic peptide
  MOD_RES (2)..(5): Any amino acid
HXXXXD

SEQ ID NO: 4283 - protein, 3 aa, Artificial Sequence
  Description of Artificial Sequence: Synthetic peptide
  MOD_RES (2)..(2): Any amino acid
PXG

SEQ ID NO: 4284 - protein, 6 aa, Artificial Sequence
  Description of Artificial Sequence: Synthetic peptide
  MOD_RES (2)..(5): Any amino acid
RXXXXL

SEQ ID NO: 4285 - protein, 5 aa, Artificial Sequence
  Description of Artificial Sequence: Synthetic peptide
  MOD_RES (3)..(4): Any amino acid
SLXXE

SEQ ID NO: 4286 - protein, 4 aa, Artificial Sequence
  Description of Artificial Sequence: Synthetic peptide
  MOD_RES (2)..(3): Any amino acid
TXXQ

SEQ ID NO: 4287 - protein, 5 aa, Artificial Sequence
  Description of Artificial Sequence: Synthetic peptide
  MOD_RES (2)..(3): Any amino acid
QXXDA

SEQ ID NO: 4288 - protein, 5 aa, Artificial Sequence
  Description of Artificial Sequence: Synthetic peptide
  MOD_RES (2)..(4): Any amino acid
FXXXN

SEQ ID NO: 4289 - protein, 6 aa, Artificial Sequence
  Description of Artificial Sequence: Synthetic peptide
  MOD_RES (2)..(5): Any amino acid
QXXXXP

SEQ ID NO: 4290 - protein, 4 aa, Artificial Sequence
  Description of Artificial Sequence: Synthetic peptide
  MOD_RES (3)..(3): Any amino acid
SPXS

SEQ ID NO: 4291 - protein, 5 aa, Artificial Sequence
  Description of Artificial Sequence: Synthetic peptide
  MOD_RES (2)..(4): Any amino acid
QXXXH

SEQ ID NO: 4292 - protein, 4 aa, Artificial Sequence
  Description of Artificial Sequence: Synthetic peptide
  MOD_RES (2)..(3): Any amino acid
NXXQ

SEQ ID NO: 4293 - protein, 6 aa, Artificial Sequence
  Description of Artificial Sequence: Synthetic peptide
  MOD_RES (2)..(4): Any amino acid
EXXXAE

SEQ ID NO: 4294 - protein, 3 aa, Artificial Sequence
  Description of Artificial Sequence: Synthetic peptide
  MOD_RES (2)..(2): Any amino acid
WXR

SEQ ID NO: 4295 - protein, 5 aa, Artificial Sequence
  Description of Artificial Sequence: Synthetic peptide
  MOD_RES (2)..(4): Any amino acid
HXXXE

SEQ ID NO: 4296 - protein, 5 aa, Artificial Sequence
  Description of Artificial Sequence: Synthetic peptide
  MOD_RES (2)..(3): Any amino acid
AXXLQ

SEQ ID NO: 4297 - protein, 3 aa, Artificial Sequence
  Description of Artificial Sequence: Synthetic peptide
NTK

SEQ ID NO: 4298 - protein, 6 aa, Artificial Sequence
  Description of Artificial Sequence: Synthetic peptide
  MOD_RES (2)..(5): Any amino acid
YXXXXG

SEQ ID NO: 4299 - protein, 6 aa, Artificial Sequence
  Description of Artificial Sequence: Synthetic peptide
  MOD_RES (2)..(5): Any amino acid
DXXXXR

SEQ ID NO: 4300 - protein, 4 aa, Artificial Sequence
  Description of Artificial Sequence: Synthetic peptide
VDKK

SEQ ID NO: 4301 - protein, 6 aa, Artificial Sequence
  Description of Artificial Sequence: Synthetic peptide
  MOD_RES (2)..(5): Any amino acid
SXXXXE

SEQ ID NO: 4302 - protein, 3 aa, Artificial Sequence
  Description of Artificial Sequence: Synthetic peptide
  MOD_RES (2)..(2): Any amino acid
NXF

SEQ ID NO: 4303 - protein, 6 aa, Artificial Sequence
  Description of Artificial Sequence: Synthetic peptide
  MOD_RES (2)..(5): Any amino acid
PXXXXR

SEQ ID NO: 4304 - protein, 4 aa, Artificial Sequence
  Description of Artificial Sequence: Synthetic peptide
  MOD_RES (2)..(2): Any amino acid
SXAD

SEQ ID NO: 4305 - protein, 5 aa, Artificial Sequence
  Description of Artificial Sequence: Synthetic peptide
  MOD_RES (2)..(4): Any amino acid
EXXXR

SEQ ID NO: 4306 - protein, 4 aa, Artificial Sequence
  Description of Artificial Sequence: Synthetic peptide
  MOD_RES (2)..(3): Any amino acid
RXXV

SEQ ID NO: 4307 - protein, 5 aa, Artificial Sequence
  Description of Artificial Sequence: Synthetic peptide
  MOD_RES (2)..(4): Any amino acid
RXXXQ

SEQ ID NO: 4308 - protein, 5 aa, Artificial Sequence
  Description of Artificial Sequence: Synthetic peptide
  MOD_RES (2)..(3): Any amino acid
RXXDG

SEQ ID NO: 4309 - protein, 5 aa, Artificial Sequence
  Description of Artificial Sequence: Synthetic peptide
  MOD_RES (2)..(4): Any amino acid
TXXXQ

SEQ ID NO: 4310 - protein, 6 aa, Artificial Sequence
  Description of Artificial Sequence: Synthetic peptide
  MOD_RES (2)..(5): Any amino acid
YXXXXK

SEQ ID NO: 4311 - protein, 6 aa, Artificial Sequence
  Description of Artificial Sequence: Synthetic peptide
  MOD_RES (2)..(5): Any amino acid
SXXXXS

SEQ ID NO: 4312 - protein, 5 aa, Artificial Sequence
  Description of Artificial Sequence: Synthetic peptide
  MOD_RES (2)..(3): Any amino acid
AXXAR

SEQ ID NO: 4313 - protein, 5 aa, Artificial Sequence
  Description of Artificial Sequence: Synthetic peptide
  MOD_RES (3)..(4): Any amino acid
AAXXQ

SEQ ID NO: 4314 - protein, 6 aa, Artificial Sequence
  Description of Artificial Sequence: Synthetic peptide
  MOD_RES (2)..(5): Any amino acid
AXXXXQ

SEQ ID NO: 4315 - protein, 3 aa, Artificial Sequence
  Description of Artificial Sequence: Synthetic peptide
ETG

SEQ ID NO: 4316 - protein, 6 aa, Artificial Sequence
  Description of Artificial Sequence: Synthetic peptide
  MOD_RES (2)..(5): Any amino acid
SXXXXL

SEQ ID NO: 4317 - protein, 5 aa, Artificial Sequence
  Description of Artificial Sequence: Synthetic peptide
  MOD_RES (2)..(4): Any amino acid
YXXXS

SEQ ID NO: 4318 - protein, 5 aa, Artificial Sequence
  Description of Artificial Sequence: Synthetic peptide
  MOD_RES (2)..(3): Any amino acid
AXXQQ

SEQ ID NO: 4319 - protein, 5 aa, Artificial Sequence
  Description of Artificial Sequence: Synthetic peptide
  MOD_RES (2)..(4): Any amino acid
AXXXQ

SEQ ID NO: 4320 - protein, 6 aa, Artificial Sequence
  Description of Artificial Sequence: Synthetic peptide
  MOD_RES (2)..(5): Any amino acid
EXXXXQ

SEQ ID NO: 4321 - protein, 5 aa, Artificial Sequence
  Description of Artificial Sequence: Synthetic peptide
  MOD_RES (2)..(4): Any amino acid
DXXXR

SEQ ID NO: 4322 - protein, 4 aa, Artificial Sequence
  Description of Artificial Sequence: Synthetic peptide
  MOD_RES (3)..(3): Any amino acid
AAXG

SEQ ID NO: 4323 - protein, 4 aa, Artificial Sequence
  Description of Artificial Sequence: Synthetic peptide
  MOD_RES (2)..(3): Any amino acid
FXXE

SEQ ID NO: 4324 - protein, 5 aa, Artificial Sequence
  Description of Artificial Sequence: Synthetic peptide
  MOD_RES (3)..(4): Any amino acid
DDXXR

SEQ ID NO: 4325 - protein, 5 aa, Artificial Sequence
  Description of Artificial Sequence: Synthetic peptide
  MOD_RES (2)..(4): Any amino acid
IXXXQ

SEQ ID NO: 4326 - protein, 6 aa, Artificial Sequence
  Description of Artificial Sequence: Synthetic peptide
  MOD_RES (2)..(5): Any amino acid
TXXXXQ

SEQ ID NO: 4327 - protein, 5 aa, Artificial Sequence
  Description of Artificial Sequence: Synthetic peptide
  MOD_RES (2)..(4): Any amino acid
RXXXL

SEQ ID NO: 4328 - protein, 6 aa, Artificial Sequence
  Description of Artificial Sequence: Synthetic peptide
  MOD_RES (2)..(5): Any amino acid
GXXXXE

SEQ ID NO: 4329 - protein, 4 aa, Artificial Sequence
  Description of Artificial Sequence: Synthetic peptide
  MOD_RES (3)..(3): Any amino acid
RAXG

SEQ ID NO: 4330 - protein, 6 aa, Artificial Sequence
  Description of Artificial Sequence: Synthetic peptide
  MOD_RES (2)..(5): Any amino acid
LXXXXL

SEQ ID NO: 4331 - protein, 3 aa, Artificial Sequence
  Description of Artificial Sequence: Synthetic peptide
YRD

SEQ ID NO: 4332 - protein, 5 aa, Artificial Sequence
  Description of Artificial Sequence: Synthetic peptide
  MOD_RES (2)..(4): Any amino acid
AXXXY

SEQ ID NO: 4333 - protein, 4 aa, Artificial Sequence
  Description of Artificial Sequence: Synthetic peptide
  MOD_RES (2)..(2): Any amino acid
YXGG

SEQ ID NO: 4334 - protein, 5 aa, Artificial Sequence
  Description of Artificial Sequence: Synthetic peptide
  MOD_RES (2)..(4): Any amino acid
VXXXN

SEQ ID NO: 4335 - protein, 5 aa, Artificial Sequence
  Description of Artificial Sequence: Synthetic peptide
  MOD_RES (2)..(4): Any amino acid
DXXXR

SEQ ID NO: 4336 - protein, 5 aa, Artificial Sequence
  Description of Artificial Sequence: Synthetic peptide
  MOD_RES (2)..(4): Any amino acid
EXXXW

SEQ ID NO: 4337 - protein, 3 aa, Artificial Sequence
  Description of Artificial Sequence: Synthetic peptide
  MOD_RES (2)..(2): Any amino acid
HXN

SEQ ID NO: 4338 - protein, 5 aa, Artificial Sequence
  Description of Artificial Sequence: Synthetic peptide
  MOD_RES (2)..(4): Any amino acid
RXXXQ

SEQ ID NO: 4339 - protein, 5 aa, Artificial Sequence
  Description of Artificial Sequence: Synthetic peptide
  MOD_RES (2)..(4): Any amino acid
YXXXK

SEQ ID NO: 4340 - protein, 5 aa, Artificial Sequence
  Description of Artificial Sequence: Synthetic peptide
  MOD_RES (2)..(4): Any amino acid
WXXXK

SEQ ID NO: 4341 - protein, 5 aa, Artificial Sequence
  Description of Artificial Sequence: Synthetic peptide
  MOD_RES (2)..(4): Any amino acid
FXXXL

SEQ ID NO: 4342 - protein, 6 aa, Artificial Sequence
  Description of Artificial Sequence: Synthetic peptide
  MOD_RES (2)..(5): Any amino acid
AXXXXL

SEQ ID NO: 4343 - protein, 4 aa, Artificial Sequence
  Description of Artificial Sequence: Synthetic peptide
  MOD_RES (2)..(2): Any amino acid
TXVD

SEQ ID NO: 4344 - protein, 5 aa, Artificial Sequence
  Description of Artificial Sequence: Synthetic peptide
  MOD_RES (2)..(4): Any amino acid
HXXXL

SEQ ID NO: 4345 - protein, 6 aa, Artificial Sequence
  Description of Artificial Sequence: Synthetic peptide
  MOD_RES (2)..(5): Any amino acid
LXXXXE

SEQ ID NO: 4346 - protein, 4 aa, Artificial Sequence
  Description of Artificial Sequence: Synthetic peptide
  MOD_RES (3)..(3): Any amino acid
LAXG

SEQ ID NO: 4347 - protein, 5 aa, Artificial Sequence
  Description of Artificial Sequence: Synthetic peptide
  MOD_RES (2)..(3): Any amino acid
KXXGL

SEQ ID NO: 4348 - protein, 6 aa, Artificial Sequence
  Description of Artificial Sequence: Synthetic peptide
  MOD_RES (2)..(5): Any amino acid
DXXXXR

SEQ ID NO: 4349 - protein, 3 aa, Artificial Sequence
  Description of Artificial Sequence: Synthetic peptide
  MOD_RES (2)..(2): Any amino acid
DXR

SEQ ID NO: 4350 - protein, 5 aa, Artificial Sequence
  Description of Artificial Sequence: Synthetic peptide
  MOD_RES (2)..(4): Any amino acid
DXXXR

SEQ ID NO: 4351 - protein, 3 aa, Artificial Sequence
  Description of Artificial Sequence: Synthetic peptide
QGQ

SEQ ID NO: 4352 - protein, 4 aa, Artificial Sequence
  Description of Artificial Sequence: Synthetic peptide
  MOD_RES (3)..(3): Any amino acid
KKXG

SEQ ID NO: 4353 - protein, 5 aa, Artificial Sequence
  Description of Artificial Sequence: Synthetic peptide
  MOD_RES (2)..(4): Any amino acid
IXXXG

SEQ ID NO: 4354 - protein, 4 aa, Artificial Sequence
  Description of Artificial Sequence: Synthetic peptide
  MOD_RES (2)..(3): Any amino acid
NXXL

SEQ ID NO: 4355 - protein, 6 aa, Artificial Sequence
  Description of Artificial Sequence: Synthetic peptide
  MOD_RES (2)..(5): Any amino acid
AXXXXE

SEQ ID NO: 4356 - protein, 6 aa, Artificial Sequence
  Description of Artificial Sequence: Synthetic peptide
  MOD_RES (2)..(5): Any amino acid
NXXXXK

SEQ ID NO: 4357 - protein, 6 aa, Artificial Sequence
  Description of Artificial Sequence: Synthetic peptide
  MOD_RES (2)..(5): Any amino acid
QXXXXK

SEQ ID NO: 4358 - protein, 5 aa, Artificial Sequence
  Description of Artificial Sequence: Synthetic peptide
  MOD_RES (2)..(4): Any amino acid
FXXXM

SEQ ID NO: 4359 - protein, 5 aa, Artificial Sequence
  Description of Artificial Sequence: Synthetic peptide
  MOD_RES (2)..(4): Any amino acid
IXXXH

SEQ ID NO: 4360 - protein, 6 aa, Artificial Sequence
  Description of Artificial Sequence: Synthetic peptide
  MOD_RES (2)..(5): Any amino acid
RXXXXR

SEQ ID NO: 4361 - protein, 5 aa, Artificial Sequence
  Description of Artificial Sequence: Synthetic peptide
  MOD_RES (3)..(4): Any amino acid
SAXXA

SEQ ID NO: 4362 - protein, 5 aa, Artificial Sequence
  Description of Artificial Sequence: Synthetic peptide
  MOD_RES (2)..(4): Any amino acid
QXXXL

SEQ ID NO: 4363 - protein, 5 aa, Artificial Sequence
  Description of Artificial Sequence: Synthetic peptide
  MOD_RES (2)..(4): Any amino acid
FXXXE

SEQ ID NO: 4364 - protein, 6 aa, Artificial Sequence
  Description of Artificial Sequence: Synthetic peptide
  MOD_RES (2)..(5): Any amino acid
AXXXXK

SEQ ID NO: 4365 - protein, 3 aa, Artificial Sequence
  Description of Artificial Sequence: Synthetic peptide
SVT

SEQ ID NO: 4366 - protein, 3 aa, Artificial Sequence
  Description of Artificial Sequence: Synthetic peptide
  MOD_RES (2)..(2): Any amino acid
SXF

SEQ ID NO: 4367 - protein, 4 aa, Artificial Sequence
  Description of Artificial Sequence: Synthetic peptide
  MOD_RES (2)..(3): Any amino acid
NXXY

SEQ ID NO: 4368 - protein, 3 aa, Artificial Sequence
  Description of Artificial Sequence: Synthetic peptide
SIP

SEQ ID NO: 4369 - protein, 5 aa, Artificial Sequence
  Description of Artificial Sequence: Synthetic peptide
  MOD_RES (2)..(4): Any amino acid
AXXXQ

SEQ ID NO: 4370 - protein, 5 aa, Artificial Sequence
  Description of Artificial Sequence: Synthetic peptide
  MOD_RES (2)..(4): Any amino acid
PXXXN

SEQ ID NO: 4371 - protein, 5 aa, Artificial Sequence
  Description of Artificial Sequence: Synthetic peptide
  MOD_RES (3)..(4): Any amino acid
PAXXA

SEQ ID NO: 4372 - protein, 4 aa, Artificial Sequence
  Description of Artificial Sequence: Synthetic peptide
  MOD_RES (2)..(3): Any amino acid
NXXM

SEQ ID NO: 4373 - protein, 5 aa, Artificial Sequence
  Description of Artificial Sequence: Synthetic peptide
  MOD_RES (2)..(4): Any amino acid
EXXXR

SEQ ID NO: 4374 - protein, 5 aa, Artificial Sequence
  Description of Artificial Sequence: Synthetic peptide
  MOD_RES (2)..(4): Any amino acid
PXXXR

SEQ ID NO: 4375 - protein, 3 aa, Artificial Sequence
  Description of Artificial Sequence: Synthetic peptide
KEG

SEQ ID NO: 4376 - protein, 3 aa, Artificial Sequence
  Description of Artificial Sequence: Synthetic peptide
  MOD_RES (2)..(2): Any amino acid
SXM

SEQ ID NO: 4377 - protein, 5 aa, Artificial Sequence
  Description of Artificial Sequence: Synthetic peptide
  MOD_RES (3)..(4): Any amino acid
ARXXA

SEQ ID NO: 4378 - protein, 6 aa, Artificial Sequence
  Description of Artificial Sequence: Synthetic peptide
  MOD_RES (2)..(5): Any amino acid
LXXXXL

SEQ ID NO: 4379 - protein, 6 aa, Artificial Sequence
  Description of Artificial Sequence: Synthetic peptide
  MOD_RES (2)..(5): Any amino acid
EXXXXS

SEQ ID NO: 4380 - protein, 5 aa, Artificial Sequence
  Description of Artificial Sequence: Synthetic peptide
  MOD_RES (2)..(4): Any amino acid
FXXXH

SEQ ID NO: 4381 - protein, 5 aa, Artificial Sequence
  Description of Artificial Sequence: Synthetic peptide
  MOD_RES (2)..(2): Any amino acid
  MOD_RES (4)..(4): Any amino acid
GXSXE

SEQ ID NO: 4382 - protein, 5 aa, Artificial Sequence
  Description of Artificial Sequence: Synthetic peptide
  MOD_RES (2)..(3): Any amino acid
DXXRS

SEQ ID NO: 4383 - protein, 3 aa, Artificial Sequence
  Description of Artificial Sequence: Synthetic peptide
GSV

SEQ ID NO: 4384 - protein, 6 aa, Artificial Sequence
  Description of Artificial Sequence: Synthetic peptide
  MOD_RES (2)..(5): Any amino acid
EXXXXR

SEQ ID NO: 4385 - protein, 5 aa, Artificial Sequence
  Description of Artificial Sequence: Synthetic peptide
  MOD_RES (2)..(4): Any amino acid
FXXXG

SEQ ID NO: 4386 - protein, 5 aa, Artificial Sequence
  Description of Artificial Sequence: Synthetic peptide
  MOD_RES (2)..(4): Any amino acid
QXXXL

SEQ ID NO: 4387 - protein, 5 aa, Artificial Sequence
  Description of Artificial Sequence: Synthetic peptide
  MOD_RES (2)..(4): Any amino acid
QXXXY

SEQ ID NO: 4388 - protein, 3 aa, Artificial Sequence
  Description of Artificial Sequence: Synthetic peptide
  MOD_RES (2)..(2): Any amino acid
LXF

SEQ ID NO: 4389 - protein, 5 aa, Artificial Sequence
  Description of Artificial Sequence: Synthetic peptide
  MOD_RES (2)..(4): Any amino acid
YXXXE

SEQ ID NO: 4390 - protein, 6 aa, Artificial Sequence
  Description of Artificial Sequence: Synthetic peptide
  MOD_RES (2)..(5): Any amino acid
EXXXXK

SEQ ID NO: 4391 - protein, 5 aa, Artificial Sequence
  Description of Artificial Sequence: Synthetic peptide
  MOD_RES (2)..(4): Any amino acid
QXXXF

SEQ ID NO: 4392 - protein, 5 aa, Artificial Sequence
  Description of Artificial Sequence: Synthetic peptide
  MOD_RES (2)..(4): Any amino acid
MXXXQ

SEQ ID NO: 4393 - protein, 5 aa, Artificial Sequence
  Description of Artificial Sequence: Synthetic peptide
  MOD_RES (2)..(4): Any amino acid
HXXXD

SEQ ID NO: 4394 - protein, 5 aa, Artificial Sequence
  Description of Artificial Sequence: Synthetic peptide
  MOD_RES (2)..(2): Any amino acid
  MOD_RES (4)..(4): Any amino acid
KXGXT

SEQ ID NO: 4395 - protein, 5 aa, Artificial Sequence
  Description of Artificial Sequence: Synthetic peptide
  MOD_RES (2)..(4): Any amino acid
PXXXM

SEQ ID NO: 4396 - protein, 3 aa, Artificial Sequence
  Description of Artificial Sequence: Synthetic peptide
  MOD_RES (2)..(2): Any amino acid
TXY

SEQ ID NO: 4397 - protein, 5 aa, Artificial Sequence
  Description of Artificial Sequence: Synthetic peptide
  MOD_RES (2)..(4): Any amino acid
RXXXN

SEQ ID NO: 4398 - protein, 4 aa, Artificial Sequence
  Description of Artificial Sequence: Synthetic peptide
  MOD_RES (2)..(2): Any amino acid
TXTG

SEQ ID NO: 4399 - protein, 4 aa, Artificial Sequence
  Description of Artificial Sequence: Synthetic peptide
  MOD_RES (2)..(3): Any amino acid
NXXH

SEQ ID NO: 4400 - protein, 5 aa, Artificial Sequence
  Description of Artificial Sequence: Synthetic peptide
  MOD_RES (2)..(4): Any amino acid
YXXXE

SEQ ID NO: 4401 - protein, 5 aa, Artificial Sequence
  Description of Artificial Sequence: Synthetic peptide
  MOD_RES (2)..(4): Any amino acid
VXXXQ

SEQ ID NO: 4402 - protein, 5 aa, Artificial Sequence
  Description of Artificial Sequence: Synthetic peptide
  MOD_RES (3)..(4): Any amino acid
REXXL

SEQ ID NO: 4403 - protein, 5 aa, Artificial Sequence
  Description of Artificial Sequence: Synthetic peptide
  MOD_RES (2)..(4): Any amino acid
NXXXY

SEQ ID NO: 4404 - protein, 6 aa, Artificial Sequence
  Description of Artificial Sequence: Synthetic peptide
  MOD_RES (3)..(5): Any amino acid
EAXXXE

SEQ ID NO: 4405 - protein, 3 aa, Artificial Sequence
  Description of Artificial Sequence: Synthetic peptide
  MOD_RES (2)..(2): Any amino acid
AXF

SEQ ID NO: 4406 - protein, 5 aa, Artificial Sequence
  Description of Artificial Sequence: Synthetic peptide
  MOD_RES (3)..(4): Any amino acid
PEXXR

SEQ ID NO: 4407 - protein, 5 aa, Artificial Sequence
  Description of Artificial Sequence: Synthetic peptide
  MOD_RES (2)..(4): Any amino acid
MXXXY

SEQ ID NO: 4408 - protein, 4 aa, Artificial Sequence
  Description of Artificial Sequence: Synthetic peptide
  MOD_RES (3)..(3): Any amino acid
ERXG

SEQ ID NO: 4409 - protein, 6 aa, Artificial Sequence
  Description of Artificial Sequence: Synthetic peptide
  MOD_RES (2)..(5): Any amino acid
TXXXXN

SEQ ID NO: 4410 - protein, 4 aa, Artificial Sequence
  Description of Artificial Sequence: Synthetic peptide
  MOD_RES (2)..(3): Any amino acid
HXXN

SEQ ID NO: 4411 - protein, 5 aa, Artificial Sequence
  Description of Artificial Sequence: Synthetic peptide
  MOD_RES (2)..(4): Any amino acid
SXXXN

SEQ ID NO: 4412 - protein, 5 aa, Artificial Sequence
  Description of Artificial Sequence: Synthetic peptide
  MOD_RES (2)..(4): Any amino acid
RXXXE

SEQ ID NO: 4413 - protein, 5 aa, Artificial Sequence
  Description of Artificial Sequence: Synthetic peptide
  MOD_RES (2)..(4): Any amino acid
NXXXF

SEQ ID NO: 4414 - protein, 5 aa, Artificial Sequence
  Description of Artificial Sequence: Synthetic peptide
  MOD_RES (2)..(4): Any amino acid
NXXXS

SEQ ID NO: 4415 - protein, 5 aa, Artificial Sequence
  Description of Artificial Sequence: Synthetic peptide
  MOD_RES (2)..(3): Any amino acid
EXXRQ

SEQ ID NO: 4416 - protein, 3 aa, Artificial Sequence
  Description of Artificial Sequence: Synthetic peptide
  MOD_RES (2)..(2): Any amino acid
NXF

SEQ ID NO: 4417 - protein, 5 aa, Artificial Sequence
  Description of Artificial Sequence: Synthetic peptide
  MOD_RES (2)..(4): Any amino acid
SXXXD

SEQ ID NO: 4418 - protein, 3 aa, Artificial Sequence
  Description of Artificial Sequence: Synthetic peptide
VNG

SEQ ID NO: 4419 - protein, 5 aa, Artificial Sequence
  Description of Artificial Sequence: Synthetic peptide
  MOD_RES (2)..(4): Any amino acid
HXXXT

SEQ ID NO: 4420 - protein, 5 aa, Artificial Sequence
  Description of Artificial Sequence: Synthetic peptide
  MOD_RES (2)..(4): Any amino acid
FXXXD

SEQ ID NO: 4421 - protein, 5 aa, Artificial Sequence
  Description of Artificial Sequence: Synthetic peptide
  MOD_RES (2)..(4): Any amino acid
NXXXN

SEQ ID NO: 4422 - protein, 5 aa, Artificial Sequence
  Description of Artificial Sequence: Synthetic peptide
  MOD_RES (2)..(3): Any amino acid
EXXLS

SEQ ID NO: 4423 - protein, 3 aa, Artificial Sequence
  Description of Artificial Sequence: Synthetic peptide
  MOD_RES (2)..(2): Any amino acid
YXA

SEQ ID NO: 4424 - protein, 6 aa, Artificial Sequence
  Description of Artificial Sequence: Synthetic peptide
  MOD_RES (2)..(5): Any amino acid
GXXXXK

SEQ ID NO: 4425 - protein, 3 aa, Artificial Sequence
  Description of Artificial Sequence: Synthetic peptide
LSE

SEQ ID NO: 4426 - protein, 4 aa, Artificial Sequence
  Description of Artificial Sequence: Synthetic peptide
  MOD_RES (3)..(3): Any amino acid
KVXK

SEQ ID NO: 4427 - protein, 5 aa, Artificial Sequence
  Description of Artificial Sequence: Synthetic peptide
  MOD_RES (2)..(3): Any amino acid
AXXER

SEQ ID NO: 4428 - protein, 5 aa, Artificial Sequence
  Description of Artificial Sequence: Synthetic peptide
  MOD_RES (2)..(4): Any amino acid
LXXXQ

SEQ ID NO: 4429 - protein, 5 aa, Artificial Sequence
  Description of Artificial Sequence: Synthetic peptide
  MOD_RES (2)..(4): Any amino acid
NXXXG

SEQ ID NO: 4430 - protein, 5 aa, Artificial Sequence
  Description of Artificial Sequence: Synthetic peptide
  MOD_RES (3)..(4): Any amino acid
DEXXR

SEQ ID NO: 4431 - protein, 3 aa, Artificial Sequence
  Description of Artificial Sequence: Synthetic peptide
  MOD_RES (2)..(2): Any amino acid
HXS

SEQ ID NO: 4432 - protein, 6 aa, Artificial Sequence
  Description of Artificial Sequence: Synthetic peptide
  MOD_RES (2)..(5): Any amino acid
RXXXXD

SEQ ID NO: 4433 - protein, 3 aa, Artificial Sequence
  Description of Artificial Sequence: Synthetic peptide
  MOD_RES (2)..(2): Any amino acid
NXA

SEQ ID NO: 4434 - protein, 5 aa, Artificial Sequence
  Description of Artificial Sequence: Synthetic peptide
  MOD_RES (2)..(4): Any amino acid
RXXXM

SEQ ID NO: 4435 - protein, 4 aa, Artificial Sequence
  Description of Artificial Sequence: Synthetic peptide
  MOD_RES (3)..(3): Any amino acid
EAXG

SEQ ID NO: 4436 - protein, 3 aa, Artificial Sequence
  Description of Artificial Sequence: Synthetic peptide
  MOD_RES (2)..(2): Any amino acid
QXF

SEQ ID NO: 4437 - protein, 3 aa, Artificial Sequence
  Description of Artificial Sequence: Synthetic peptide
  MOD_RES (2)..(2): Any amino acid
NXY

SEQ ID NO: 4438 - protein, 5 aa, Artificial Sequence
  Description of Artificial Sequence: Synthetic peptide
  MOD_RES (2)..(4): Any amino acid
WXXXS

SEQ ID NO: 4439 - protein, 4 aa, Artificial Sequence
  Description of Artificial Sequence: Synthetic peptide
  MOD_RES (2)..(3): Any amino acid
NXXD

SEQ ID NO: 4440 - protein, 5 aa, Artificial Sequence
  Description of Artificial Sequence: Synthetic peptide
  MOD_RES (2)..(4): Any amino acid
AXXXQ

SEQ ID NO: 4441 - protein, 4 aa, Artificial Sequence
  Description of Artificial Sequence: Synthetic peptide
  MOD_RES (2)..(3): Any amino acid
PXXQ

SEQ ID NO: 4442 - protein, 3 aa, Artificial Sequence
  Description of Artificial Sequence: Synthetic peptide
  MOD_RES (2)..(2): Any amino acid
SXA

SEQ ID NO: 4443 - protein, 5 aa, Artificial Sequence
  Description of Artificial Sequence: Synthetic peptide
  MOD_RES (3)..(4): Any amino acid
AAXXR

SEQ ID NO: 4444 - protein, 3 aa, Artificial Sequence
  Description of Artificial Sequence: Synthetic peptide
  MOD_RES (2)..(2): Any amino acid
TXA

SEQ ID NO: 4445 - protein, 4 aa, Artificial Sequence
  Description of Artificial Sequence: Synthetic peptide
  MOD_RES (3)..(3): Any amino acid
LPXE

SEQ ID NO: 4446 - protein, 5 aa, Artificial Sequence
  Description of Artificial Sequence: Synthetic peptide
  MOD_RES (2)..(4): Any amino acid
QXXXE

SEQ ID NO: 4447 - protein, 6 aa, Artificial Sequence
  Description of Artificial Sequence: Synthetic peptide
  MOD_RES (2)..(5): Any amino acid
SXXXXR

SEQ ID NO: 4448 - protein, 5 aa, Artificial Sequence
  Description of Artificial Sequence: Synthetic peptide
  MOD_RES (2)..(4): Any amino acid
QXXXM

SEQ ID NO: 4449 - protein, 3 aa, Artificial Sequence
  Description of Artificial Sequence: Synthetic peptide
  MOD_RES (2)..(2): Any amino acid
FXA

SEQ ID NO: 4450 - protein, 5 aa, Artificial Sequence
  Description of Artificial Sequence: Synthetic peptide
  MOD_RES (3)..(4): Any amino acid
RRXXA

SEQ ID NO: 4451 - protein, 3 aa, Artificial Sequence
  Description of Artificial Sequence: Synthetic peptide
AAG

SEQ ID NO: 4452 - protein, 5 aa, Artificial Sequence
  Description of Artificial Sequence: Synthetic peptide
  MOD_RES (2)..(4): Any amino acid
RXXXH

SEQ ID NO: 4453 - protein, 4 aa, Artificial Sequence
  Description of Artificial Sequence: Synthetic peptide
  MOD_RES (3)..(3): Any amino acid
KAXG

SEQ ID NO: 4454 - protein, 4 aa, Artificial Sequence
  Description of Artificial Sequence: Synthetic peptide
  MOD_RES (2)..(3): Any amino acid
SXXG

SEQ ID NO: 4455 - protein, 5 aa, Artificial Sequence
  Description of Artificial Sequence: Synthetic peptide
  MOD_RES (2)..(4): Any amino acid
NXXXL

SEQ ID NO: 4456 - protein, 5 aa, Artificial Sequence
  Description of Artificial Sequence: Synthetic peptide
  MOD_RES (2)..(4): Any amino acid
SXXXQ

SEQ ID NO: 4457 - protein, 5 aa, Artificial Sequence
  Description of Artificial Sequence: Synthetic peptide
  MOD_RES (2)..(4): Any amino acid
VXXXE

SEQ ID NO: 4458 - protein, 5 aa, Artificial Sequence
  Description of Artificial Sequence: Synthetic peptide
  MOD_RES (2)..(4): Any amino acid
YXXXD

SEQ ID NO: 4459 - protein, 3 aa, Artificial Sequence
  Description of Artificial Sequence: Synthetic peptide
TFP

SEQ ID NO: 4460 - protein, 5 aa, Artificial Sequence
  Description of Artificial Sequence: Synthetic peptide
  MOD_RES (2)..(4): Any amino acid
DXXXW

SEQ ID NO: 4461 - protein, 3 aa, Artificial Sequence
  Description of Artificial Sequence: Synthetic peptide
  MOD_RES (2)..(2): Any amino acid
PXN

SEQ ID NO: 4462 - protein, 5 aa, Artificial Sequence
  Description of Artificial Sequence: Synthetic peptide
  MOD_RES (2)..(4): Any amino acid
TXXXG

SEQ ID NO: 4463 - protein, 5 aa, Artificial Sequence
  Description of Artificial Sequence: Synthetic peptide
  MOD_RES (2)..(4): Any amino acid
MXXXR

SEQ ID NO: 4464 - protein, 3 aa, Artificial Sequence
  Description of Artificial Sequence: Synthetic peptide
  MOD_RES (2)..(2): Any amino acid
WXN

SEQ ID NO: 4465 - protein, 5 aa, Artificial Sequence
  Description of Artificial Sequence: Synthetic peptide
  MOD_RES (2)..(4): Any amino acid
VXXXT

SEQ ID NO: 4466 - protein, 6 aa, Artificial Sequence
  Description of Artificial Sequence: Synthetic peptide
  MOD_RES (2)..(5): Any amino acid
EXXXXE

SEQ ID NO: 4467 - protein, 5 aa, Artificial Sequence
  Description of Artificial Sequence: Synthetic peptide
  MOD_RES (2)..(3): Any amino acid
AXXRA

SEQ ID NO: 4468 - protein, 6 aa, Artificial Sequence
  Description of Artificial Sequence: Synthetic peptide
  MOD_RES (2)..(5): Any amino acid
DXXXXP

SEQ ID NO: 4469 - protein, 5 aa, Artificial Sequence
  Description of Artificial Sequence: Synthetic peptide
  MOD_RES (2)..(4): Any amino acid
YXXXV

SEQ ID NO: 4470 - protein, 6 aa, Artificial Sequence
  Description of Artificial Sequence: Synthetic peptide
  MOD_RES (2)..(5): Any amino acid
EXXXXR

SEQ ID NO: 4471 - protein, 5 aa, Artificial Sequence
  Description of Artificial Sequence: Synthetic peptide
  MOD_RES (2)..(3): Any amino acid
AXXQR

SEQ ID NO: 4472 - protein, 5 aa, Artificial Sequence
  Description of Artificial Sequence: Synthetic peptide
  MOD_RES (2)..(4): Any amino acid
IXXXD

SEQ ID NO: 4473 - protein, 6 aa, Artificial Sequence
  Description of Artificial Sequence: Synthetic peptide
  MOD_RES (2)..(5): Any amino acid
NXXXXD

SEQ ID NO: 4474 - protein, 5 aa, Artificial Sequence
  Description of Artificial Sequence: Synthetic peptide
  MOD_RES (2)..(4): Any amino acid
WXXXL

SEQ ID NO: 4475 - protein, 4 aa, Artificial Sequence
  Description of Artificial Sequence: Synthetic peptide
  MOD_RES (2)..(3): Any amino acid
WXXE

SEQ ID NO: 4476 - protein, 3 aa, Artificial Sequence
  Description of Artificial Sequence: Synthetic peptide
FPG

SEQ ID NO: 4477 - protein, 2 aa, Artificial Sequence
  Description of Artificial Sequence: Synthetic peptide
YH

SEQ ID NO: 4478 - protein, 6 aa, Artificial Sequence
  Description of Artificial Sequence: Synthetic peptide
  MOD_RES (2)..(5): Any amino acid
DXXXXE

SEQ ID NO: 4479 - protein, 4 aa, Artificial Sequence
  Description of Artificial Sequence: Synthetic peptide
  MOD_RES (2)..(3): Any amino acid
QXXR

SEQ ID NO: 4480 - protein, 3 aa, Artificial Sequence
  Description of Artificial Sequence: Synthetic peptide
LGL

SEQ ID NO: 4481 - protein, 3 aa, Artificial Sequence
  Description of Artificial Sequence: Synthetic peptide
PGY

SEQ ID NO: 4482 - protein, 5 aa, Artificial Sequence
  Description of Artificial Sequence: Synthetic peptide
  MOD_RES (2)..(4): Any amino acid
HXXXI

SEQ ID NO: 4483 - protein, 5 aa, Artificial Sequence
  Description of Artificial Sequence: Synthetic peptide
  MOD_RES (3)..(4): Any amino acid
AEXXQ

SEQ ID NO: 4484 - protein, 5 aa, Artificial Sequence
  Description of Artificial Sequence: Synthetic peptide
  MOD_RES (2)..(3): Any amino acid
EXXAS

SEQ ID NO: 4485 - protein, 5 aa, Artificial Sequence
  Description of Artificial Sequence: Synthetic peptide
  MOD_RES (2)..(3): Any amino acid
DXXRQ

SEQ ID NO: 4486 - protein, 5 aa, Artificial Sequence
  Description of Artificial Sequence: Synthetic peptide
  MOD_RES (2)..(4): Any amino acid
EXXXF

SEQ ID NO: 4487 - protein, 4 aa, Artificial Sequence
  Description of Artificial Sequence: Synthetic peptide
  MOD_RES (3)..(3): Any amino acid
AEXG

SEQ ID NO: 4488 - protein, 3 aa, Artificial Sequence
  Description of Artificial Sequence: Synthetic peptide
ASG

SEQ ID NO: 4489 - protein, 3 aa, Artificial Sequence
  Description of Artificial Sequence: Synthetic peptide
DAA

SEQ ID NO: 4490 - protein, 6 aa, Artificial Sequence
  Description of Artificial Sequence: Synthetic peptide
  MOD_RES (2)..(5): Any amino acid
KXXXXN

SEQ ID NO: 4491 - protein, 5 aa, Artificial Sequence
  Description of Artificial Sequence: Synthetic peptide
  MOD_RES (2)..(4): Any amino acid
QXXXS

SEQ ID NO: 4492 - protein, 5 aa, Artificial Sequence
  Description of Artificial Sequence: Synthetic peptide
  MOD_RES (2)..(4): Any amino acid
IXXXE

SEQ ID NO: 4493 - protein, 5 aa, Artificial Sequence
  Description of Artificial Sequence: Synthetic peptide
  MOD_RES (2)..(4): Any amino acid
QXXXT

SEQ ID NO: 4494 - protein, 5 aa, Artificial Sequence
  Description of Artificial Sequence: Synthetic peptide
  MOD_RES (2)..(4): Any amino acid
FXXXL

SEQ ID NO: 4495 - protein, 6 aa, Artificial Sequence
  Description of Artificial Sequence: Synthetic peptide
  MOD_RES (2)..(5): Any amino acid
VXXXXL

SEQ ID NO: 4496 - protein, 4 aa, Artificial Sequence
  Description of Artificial Sequence: Synthetic peptide
  MOD_RES (2)..(3): Any amino acid
QXXR

SEQ ID NO: 4497 - protein, 5 aa, Artificial Sequence
  Description of Artificial Sequence: Synthetic peptide
  MOD_RES (2)..(4): Any amino acid
TXXXY

SEQ ID NO: 4498 - protein, 2 aa, Artificial Sequence
  Description of Artificial Sequence: Synthetic peptide
NF

SEQ ID NO: 4499 - protein, 2 aa, Artificial Sequence
  Description of Artificial Sequence: Synthetic peptide
DH

SEQ ID NO: 4500 - protein, 5 aa, Artificial Sequence
  Description of Artificial Sequence: Synthetic peptide
  MOD_RES (2)..(3): Any amino acid
QXXER

SEQ ID NO: 4501 - protein, 3 aa, Artificial Sequence
  Description of Artificial Sequence: Synthetic peptide
DAG

SEQ ID NO: 4502 - protein, 5 aa, Artificial Sequence
  Description of Artificial Sequence: Synthetic peptide
  MOD_RES (3)..(4): Any amino acid
QQXXA

SEQ ID NO: 4503 - protein, 5 aa, Artificial Sequence
  Description of Artificial Sequence: Synthetic peptide
  MOD_RES (2)..(4): Any amino acid
LXXXT

SEQ ID NO: 4504 - protein, 5 aa, Artificial Sequence
  Description of Artificial Sequence: Synthetic peptide
  MOD_RES (3)..(4): Any amino acid
QAXXD

SEQ ID NO: 4505 - protein, 6 aa, Artificial Sequence
  Description of Artificial Sequence: Synthetic peptide
  MOD_RES (2)..(5): Any amino acid
KXXXXR

SEQ ID NO: 4506 - protein, 4 aa, Artificial Sequence
  Description of Artificial Sequence: Synthetic peptide
  MOD_RES (2)..(2): Any amino acid
SXEQ

SEQ ID NO: 4507 - protein, 3 aa, Artificial Sequence
  Description of Artificial Sequence: Synthetic peptide
  MOD_RES (2)..(2): Any amino acid
QXW

SEQ ID NO: 4508 - protein, 5 aa, Artificial Sequence
  Description of Artificial Sequence: Synthetic peptide
  MOD_RES (2)..(4): Any amino acid
RXXXE

SEQ ID NO: 4509 - protein, 4 aa, Artificial Sequence
  Description of Artificial Sequence: Synthetic peptide
  MOD_RES (2)..(3): Any amino acid
NXXL

SEQ ID NO: 4510 - protein, 5 aa, Artificial Sequence
  Description of Artificial Sequence: Synthetic peptide
  MOD_RES (2)..(4): Any amino acid
IXXXR

SEQ ID NO: 4511 - protein, 5 aa, Artificial Sequence
  Description of Artificial Sequence: Synthetic peptide
  MOD_RES (2)..(4): Any amino acid
SXXXG

SEQ ID NO: 4512 - protein, 5 aa, Artificial Sequence
  Description of Artificial Sequence: Synthetic peptide
  MOD_RES (2)..(4): Any amino acid
EXXXQ

SEQ ID NO: 4513 - protein, 3 aa, Artificial Sequence
  Description of Artificial Sequence: Synthetic peptide
  MOD_RES (2)..(2): Any amino acid
QXP

SEQ ID NO: 4514 - protein, 4 aa, Artificial Sequence
  Description of Artificial Sequence: Synthetic peptide
  MOD_RES (2)..(3): Any amino acid
SXXM

SEQ ID NO: 4515 - protein, 5 aa, Artificial Sequence
  Description of Artificial Sequence: Synthetic peptide
  MOD_RES (2)..(4): Any amino acid
SXXXL

SEQ ID NO: 4516 - protein, 3 aa, Artificial Sequence
  Description of Artificial Sequence: Synthetic peptide
NPT

SEQ ID NO: 4517 - protein, 4 aa, Artificial Sequence
  Description of Artificial Sequence: Synthetic peptide
  MOD_RES (2)..(3): Any amino acid
GXXQ

SEQ ID NO: 4518 - protein, 4 aa, Artificial Sequence
  Description of Artificial Sequence: Synthetic peptide
  MOD_RES (2)..(3): Any amino acid
NXXN

SEQ ID NO: 4519 - protein, 6 aa, Artificial Sequence
  Description of Artificial Sequence: Synthetic peptide
  MOD_RES (2)..(5): Any amino acid
RXXXXP

SEQ ID NO: 4520 - protein, 3 aa, Artificial Sequence
  Description of Artificial Sequence: Synthetic peptide
  MOD_RES (2)..(2): Any amino acid
SXQ

SEQ ID NO: 4521 - protein, 4 aa, Artificial Sequence
  Description of Artificial Sequence: Synthetic peptide
  MOD_RES (2)..(2): Any amino acid
EXLG

SEQ ID NO: 4522 - protein, 5 aa, Artificial Sequence
  Description of Artificial Sequence: Synthetic peptide
  MOD_RES (2)..(4): Any amino acid
YXXXT

SEQ ID NO: 4523 - protein, 3 aa, Artificial Sequence
  Description of Artificial Sequence: Synthetic peptide
SEA

SEQ ID NO: 4524 - protein, 5 aa, Artificial Sequence
  Description of Artificial Sequence: Synthetic peptide
  MOD_RES (2)..(4): Any amino acid
SXXXR

SEQ ID NO: 4525 - protein, 5 aa, Artificial Sequence
  Description of Artificial Sequence: Synthetic peptide
  MOD_RES (2)..(4): Any amino acid
LXXXN

SEQ ID NO: 4526 - protein, 5 aa, Artificial Sequence
  Description of Artificial Sequence: Synthetic peptide
  MOD_RES (2)..(4): Any amino acid
LXXXR

SEQ ID NO: 4527 - protein, 4 aa, Artificial Sequence
  Description of Artificial Sequence: Synthetic peptide
  MOD_RES (2)..(3): Any amino acid
EXXR

SEQ ID NO: 4528 - protein, 5 aa, Artificial Sequence
  Description of Artificial Sequence: Synthetic peptide
  MOD_RES (2)..(4): Any amino acid
RXXXF

SEQ ID NO: 4529 - protein, 3 aa, Artificial Sequence
  Description of Artificial Sequence: Synthetic peptide
ALG

SEQ ID NO: 4530 - protein, 4 aa, Artificial Sequence
  Description of Artificial Sequence: Synthetic peptide
  MOD_RES (2)..(2): Any amino acid
SXDE

SEQ ID NO: 4531 - protein, 5 aa, Artificial Sequence
  Description of Artificial Sequence: Synthetic peptide
  MOD_RES (2)..(4): Any amino acid
TXXXN

SEQ ID NO: 4532 - protein, 5 aa, Artificial Sequence
  Description of Artificial Sequence: Synthetic peptide
  MOD_RES (2)..(4): Any amino acid
EXXXY

SEQ ID NO: 4533 - protein, 6 aa, Artificial Sequence
  Description of Artificial Sequence: Synthetic peptide
  MOD_RES (2)..(5): Any amino acid
RXXXXN

SEQ ID NO: 4534 - protein, 6 aa, Artificial Sequence
  Description of Artificial Sequence: Synthetic peptide
  MOD_RES (2)..(5): Any amino acid
DXXXXQ

SEQ ID NO: 4535 - protein, 5 aa, Artificial Sequence
  Description of Artificial Sequence: Synthetic peptide
  MOD_RES (2)..(4): Any amino acid
LXXXY

SEQ ID NO: 4536 - protein, 4 aa, Artificial Sequence
  Description of Artificial Sequence: Synthetic peptide
  MOD_RES (2)..(3): Any amino acid
QXXC

SEQ ID NO: 4537 - protein, 3 aa, Artificial Sequence
  Description of Artificial Sequence: Synthetic peptide
  MOD_RES (2)..(2): Any amino acid
PXS

SEQ ID NO: 4538 - protein, 4 aa, Artificial Sequence
  Description of Artificial Sequence: Synthetic peptide
  MOD_RES (2)..(3): Any amino acid
SXXE

SEQ ID NO: 4539 - protein, 4 aa, Artificial Sequence
  Description of Artificial Sequence: Synthetic peptide
  MOD_RES (2)..(3): Any amino acid
WXXQ

SEQ ID NO: 4540 - protein, 5 aa, Artificial Sequence
  Description of Artificial Sequence: Synthetic peptide
  MOD_RES (2)..(4): Any amino acid
TXXXR

SEQ ID NO: 4541 - protein, 4 aa, Artificial Sequence
  Description of Artificial Sequence: Synthetic peptide
  MOD_RES (2)..(3): Any amino acid
SXXQ

SEQ ID NO: 4542 - protein, 5 aa, Artificial Sequence
  Description of Artificial Sequence: Synthetic peptide
  MOD_RES (3)..(4): Any amino acid
QEXXA

SEQ ID NO: 4543 - protein, 5 aa, Artificial Sequence
  Description of Artificial Sequence: Synthetic peptide
  MOD_RES (2)..(4): Any amino acid
NXXXI

SEQ ID NO: 4544 - protein, 5 aa, Artificial Sequence
  Description of Artificial Sequence: Synthetic peptide
  MOD_RES (2)..(3): Any amino acid
AXXDA

SEQ ID NO: 4545 - protein, 6 aa, Artificial Sequence
  Description of Artificial Sequence: Synthetic peptide
  MOD_RES (2)..(5): Any amino acid
RXXXXE

SEQ ID NO: 4546 - protein, 5 aa, Artificial Sequence
  Description of Artificial Sequence: Synthetic peptide
  MOD_RES (2)..(4): Any amino acid
VXXXQ

SEQ ID NO: 4547 - protein, 5 aa, Artificial Sequence
  Description of Artificial Sequence: Synthetic peptide
  MOD_RES (2)..(4): Any amino acid
HXXXM

SEQ ID NO: 4548 - protein, 3 aa, Artificial Sequence
  Description of Artificial Sequence: Synthetic peptide
KYG

SEQ ID NO: 4549 - protein, 4 aa, Artificial Sequence
  Description of Artificial Sequence: Synthetic peptide
  MOD_RES (3)..(3): Any amino acid
EEXG

SEQ ID NO: 4550 - protein, 3 aa, Artificial Sequence
  Description of Artificial Sequence: Synthetic peptide
  MOD_RES (2)..(2): Any amino acid
NXQ

SEQ ID NO: 4551 - protein, 5 aa, Artificial Sequence
  Description of Artificial Sequence: Synthetic peptide
  MOD_RES (2)..(4): Any amino acid
RXXXD

SEQ ID NO: 4552 - protein, 3 aa, Artificial Sequence
  Description of Artificial Sequence: Synthetic peptide
  MOD_RES (2)..(2): Any amino acid
DXY

SEQ ID NO: 4553 - protein, 5 aa, Artificial Sequence
  Description of Artificial Sequence: Synthetic peptide
  MOD_RES (2)..(4): Any amino acid
EXXXF

SEQ ID NO: 4554 - protein, 5 aa, Artificial Sequence
  Description of Artificial Sequence: Synthetic peptide
  MOD_RES (2)..(4): Any amino acid
PXXXE

SEQ ID NO: 4555 - protein, 6 aa, Artificial Sequence
  Description of Artificial Sequence: Synthetic peptide
  MOD_RES (2)..(5): Any amino acid
VXXXXE

SEQ ID NO: 4556 - protein, 5 aa, Artificial Sequence
  Description of Artificial Sequence: Synthetic peptide
  MOD_RES (3)..(4): Any amino acid
AQXXA

SEQ ID NO: 4557 - protein, 5 aa, Artificial Sequence
  Description of Artificial Sequence: Synthetic peptide
  MOD_RES (3)..(4): Any amino acid
EAXXA

SEQ ID NO: 4558 - protein, 5 aa, Artificial Sequence
  Description of Artificial Sequence: Synthetic peptide
  MOD_RES (2)..(4): Any amino acid
MXXXD

SEQ ID NO: 4559 - protein, 5 aa, Artificial Sequence
  Description of Artificial Sequence: Synthetic peptide
  MOD_RES (2)..(4): Any amino acid
NXXXT

SEQ ID NO: 4560 - protein, 3 aa, Artificial Sequence
  Description of Artificial Sequence: Synthetic peptide
AGP

SEQ ID NO: 4561 - protein, 5 aa, Artificial Sequence
  Description of Artificial Sequence: Synthetic peptide
  MOD_RES (2)..(4): Any amino acid
RXXXE

SEQ ID NO: 4562 - protein, 3 aa, Artificial Sequence
  Description of Artificial Sequence: Synthetic peptide
QAG

SEQ ID NO: 4563 - protein, 5 aa, Artificial Sequence
  Description of Artificial Sequence: Synthetic peptide
  MOD_RES (2)..(4): Any amino acid
YXXXG

SEQ ID NO: 4564 - protein, 5 aa, Artificial Sequence
  Description of Artificial Sequence: Synthetic peptide
  MOD_RES (2)..(4): Any amino acid
RXXXI

SEQ ID NO: 4565 - protein, 2 aa, Artificial Sequence
  Description of Artificial Sequence: Synthetic peptide
HH

SEQ ID NO: 4566 - protein, 5 aa, Artificial Sequence
  Description of Artificial Sequence: Synthetic peptide
  MOD_RES (3)..(4): Any amino acid
RRXXE

SEQ ID NO: 4567 - protein, 5 aa, Artificial Sequence
  Description of Artificial Sequence: Synthetic peptide
  MOD_RES (2)..(4): Any amino acid
IXXXR

SEQ ID NO: 4568 - protein, 5 aa, Artificial Sequence
  Description of Artificial Sequence: Synthetic peptide
  MOD_RES (2)..(4): Any amino acid
AXXXR

SEQ ID NO: 4569 - protein, 5 aa, Artificial Sequence
  Description of Artificial Sequence: Synthetic peptide
  MOD_RES (2)..(3): Any amino acid
RXXAL

SEQ ID NO: 4570 - protein, 5 aa, Artificial Sequence
  Description of Artificial Sequence: Synthetic peptide
  MOD_RES (2)..(4): Any amino acid
VXXXE

SEQ ID NO: 4571 - protein, 5 aa, Artificial Sequence
  Description of Artificial Sequence: Synthetic peptide
  MOD_RES (2)..(4): Any amino acid
NXXXH

SEQ ID NO: 4572 - protein, 3 aa, Artificial Sequence
  Description of Artificial Sequence: Synthetic peptide
  MOD_RES (2)..(2): Any amino acid
GXW

SEQ ID NO: 4573 - protein, 3 aa, Artificial Sequence
  Description of Artificial Sequence: Synthetic peptide
IPS

SEQ ID NO: 4574 - protein, 5 aa, Artificial Sequence
  Description of Artificial Sequence: Synthetic peptide
  MOD_RES (2)..(4): Any amino acid
RXXXL

SEQ ID NO: 4575 - protein, 3 aa, Artificial Sequence
  Description of Artificial Sequence: Synthetic peptide
  MOD_RES (2)..(2): Any amino acid
DXY

SEQ ID NO: 4576 - protein, 5 aa, Artificial Sequence
  Description of Artificial Sequence: Synthetic peptide
  MOD_RES (2)..(4): Any amino acid
SXXXN

SEQ ID NO: 4577 - protein, 5 aa, Artificial Sequence
  Description of Artificial Sequence: Synthetic peptide
  MOD_RES (2)..(4): Any amino acid
RXXXI

SEQ ID NO: 4578 - protein, 5 aa, Artificial Sequence
  Description of Artificial Sequence: Synthetic peptide
  MOD_RES (2)..(4): Any amino acid
TXXXF

SEQ ID NO: 4579 - protein, 5 aa, Artificial Sequence
  Description of Artificial Sequence: Synthetic peptide
  MOD_RES (2)..(3): Any amino acid
QXXID

SEQ ID NO: 4580 - protein, 4 aa, Artificial Sequence
  Description of Artificial Sequence: Synthetic peptide
  MOD_RES (2)..(3): Any amino acid
EXXR

SEQ ID NO: 4581 - protein, 3 aa, Artificial Sequence
  Description of Artificial Sequence: Synthetic peptide
PGP

SEQ ID NO: 4582 - protein, 3 aa, Artificial Sequence
  Description of Artificial Sequence: Synthetic peptide
  MOD_RES (2)..(2): Any amino acid
QXN

SEQ ID NO: 4583 - protein, 5 aa, Artificial Sequence
  Description of Artificial Sequence: Synthetic peptide
  MOD_RES (2)..(4): Any amino acid
LXXXN

SEQ ID NO: 4584 - protein, 5 aa, Artificial Sequence
  Description of Artificial Sequence: Synthetic peptide
  MOD_RES (2)..(4): Any amino acid
PXXXT

SEQ ID NO: 4585 - protein, 4 aa, Artificial Sequence
  Description of Artificial Sequence: Synthetic peptide
  MOD_RES (2)..(3): Any amino acid
DXXY

SEQ ID NO: 4586 - protein, 5 aa, Artificial Sequence
  Description of Artificial Sequence: Synthetic peptide
  MOD_RES (2)..(4): Any amino acid
FXXXE

SEQ ID NO: 4587 - protein, 4 aa, Artificial Sequence
  Description of Artificial Sequence: Synthetic peptide
  MOD_RES (2)..(3): Any amino acid
RXXE

SEQ ID NO: 4588 - protein, 6 aa, Artificial Sequence
  Description of Artificial Sequence: Synthetic peptide
  MOD_RES (2)..(5): Any amino acid
NXXXXR

SEQ ID NO: 4589 - protein, 5 aa, Artificial Sequence
  Description of Artificial Sequence: Synthetic peptide
  MOD_RES (2)..(4): Any amino acid
YXXXK

SEQ ID NO: 4590 - protein, 5 aa, Artificial Sequence
  Description of Artificial Sequence: Synthetic peptide
  MOD_RES (2)..(3): Any amino acid
AXXQA

SEQ ID NO: 4591 - protein, 5 aa, Artificial Sequence
  Description of Artificial Sequence: Synthetic peptide
  MOD_RES (2)..(4): Any amino acid
IXXXN

SEQ ID NO: 4592 - protein, 5 aa, Artificial Sequence
  Description of Artificial Sequence: Synthetic peptide
  MOD_RES (2)..(3): Any amino acid
RXXRE

SEQ ID NO: 4593 - protein, 5 aa, Artificial Sequence
  Description of Artificial Sequence: Synthetic peptide
  MOD_RES (2)..(3): Any amino acid
DXXRA

SEQ ID NO: 4594 - protein, 6 aa, Artificial Sequence
  Description of Artificial Sequence: Synthetic peptide
  MOD_RES (2)..(5): Any amino acid
DXXXXK

SEQ ID NO: 4595 - protein, 3 aa, Artificial Sequence
  Description of Artificial Sequence: Synthetic peptide
  MOD_RES (2)..(2): Any amino acid
SXF

SEQ ID NO: 4596 - protein, 5 aa, Artificial Sequence
  Description of Artificial Sequence: Synthetic peptide
  MOD_RES (3)..(4): Any amino acid
ALXXE

SEQ ID NO: 4597 - protein, 5 aa, Artificial Sequence
  Description of Artificial Sequence: Synthetic peptide
  MOD_RES (2)..(4): Any amino acid
RXXXG

SEQ ID NO: 4598 - protein, 5 aa, Artificial Sequence
  Description of Artificial Sequence: Synthetic peptide
  MOD_RES (2)..(4): Any amino acid
FXXXD

SEQ ID NO: 4599 - protein, 6 aa, Artificial Sequence
  Description of Artificial Sequence: Synthetic peptide
  MOD_RES (2)..(5): Any amino acid
GXXXXD

SEQ ID NO: 4600 - protein, 5 aa, Artificial Sequence
  Description of Artificial Sequence: Synthetic peptide
  MOD_RES (2)..(4): Any amino acid
FXXXK

SEQ ID NO: 4601 - protein, 5 aa, Artificial Sequence
  Description of Artificial Sequence: Synthetic peptide
  MOD_RES (3)..(4): Any amino acid
LAXXE

SEQ ID NO: 4602 - protein, 4 aa, Artificial Sequence
  Description of Artificial Sequence: Synthetic peptide
  MOD_RES (2)..(3): Any amino acid
WXXG

SEQ ID NO: 4603 - protein, 5 aa, Artificial Sequence
  Description of Artificial Sequence: Synthetic peptide
  MOD_RES (2)..(4): Any amino acid
IXXXE

SEQ ID NO: 4604 - protein, 5 aa, Artificial Sequence
  Description of Artificial Sequence: Synthetic peptide
  MOD_RES (3)..(4): Any amino acid
QEXXR

SEQ ID NO: 4605 - protein, 4 aa, Artificial Sequence
  Description of Artificial Sequence: Synthetic peptide
  MOD_RES (2)..(3): Any amino acid
TXXQ

SEQ ID NO: 4606 - protein, 5 aa, Artificial Sequence
  Description of Artificial Sequence: Synthetic peptide
  MOD_RES (2)..(4): Any amino acid
DXXXF

SEQ ID NO: 4607 - protein, 4 aa, Artificial Sequence
  Description of Artificial Sequence: Synthetic peptide
  MOD_RES (2)..(3): Any amino acid
YXXS

SEQ ID NO: 4608 - protein, 4 aa, Artificial Sequence
  Description of Artificial Sequence: Synthetic peptide
  MOD_RES (2)..(2): Any amino acid
KXLG

SEQ ID NO: 4609 - protein, 5 aa, Artificial Sequence
  Description of Artificial Sequence: Synthetic peptide
  MOD_RES (2)..(4): Any amino acid
VXXXY

SEQ ID NO: 4610 - protein, 6 aa, Artificial Sequence
  Description of Artificial Sequence: Synthetic peptide
  MOD_RES (2)..(5): Any amino acid
SXXXXA

SEQ ID NO: 4611 - protein, 5 aa, Artificial Sequence
  Description of Artificial Sequence: Synthetic peptide
  MOD_RES (2)..(4): Any amino acid
DXXXS

SEQ ID NO: 4612 - protein, 5 aa, Artificial Sequence
  Description of Artificial Sequence: Synthetic peptide
  MOD_RES (2)..(4): Any amino acid
PXXXS

SEQ ID NO: 4613 - protein, 4 aa, Artificial Sequence
  Description of Artificial Sequence: Synthetic peptide
  MOD_RES (2)..(3): Any amino acid
YXXQ

SEQ ID NO: 4614 - protein, 6 aa, Artificial Sequence
  Description of Artificial Sequence: Synthetic peptide
  MOD_RES (2)..(5): Any amino acid
GXXXXA

SEQ ID NO: 4615 - protein, 3 aa, Artificial Sequence
  Description of Artificial Sequence: Synthetic peptide
  MOD_RES (2)..(2): Any amino acid
GXH

SEQ ID NO: 4616 - protein, 5 aa, Artificial Sequence
  Description of Artificial Sequence: Synthetic peptide
  MOD_RES (2)..(4): Any amino acid
QXXXI

SEQ ID NO: 4617 - protein, 3 aa, Artificial Sequence
  Description of Artificial Sequence: Synthetic peptide
  MOD_RES (2)..(2): Any amino acid
QXY

SEQ ID NO: 4618 - protein, 6 aa, Artificial Sequence
  Description of Artificial Sequence: Synthetic peptide
  MOD_RES (2)..(5): Any amino acid
EXXXXY

SEQ ID NO: 4619 - protein, 4 aa, Artificial Sequence
  Description of Artificial Sequence: Synthetic peptide
  MOD_RES (2)..(3): Any amino acid
NXXG

SEQ ID NO: 4620 - protein, 5 aa, Artificial Sequence
  Description of Artificial Sequence: Synthetic peptide
  MOD_RES (2)..(4): Any amino acid
PXXXQ

SEQ ID NO: 4621 - protein, 2 aa, Artificial Sequence
  Description of Artificial Sequence: Synthetic peptide
NW

SEQ ID NO: 4622 - protein, 5 aa, Artificial Sequence
  Description of Artificial Sequence: Synthetic peptide
  MOD_RES (2)..(3): Any amino acid
AXXAE

SEQ ID NO: 4623 - protein, 5 aa, Artificial Sequence
  Description of Artificial Sequence: Synthetic peptide
  MOD_RES (2)..(4): Any amino acid
QXXXA

SEQ ID NO: 4624 - protein, 3 aa, Artificial Sequence
  Description of Artificial Sequence: Synthetic peptide
DGS

SEQ ID NO: 4625 - protein, 4 aa, Artificial Sequence
  Description of Artificial Sequence: Synthetic peptide
  MOD_RES (2)..(2): Any amino acid
TXEQ

SEQ ID NO: 4626 - protein, 5 aa, Artificial Sequence
  Description of Artificial Sequence: Synthetic peptide
  MOD_RES (3)..(4): Any amino acid
REXXA

SEQ ID NO: 4627 - protein, 6 aa, Artificial Sequence
  Description of Artificial Sequence: Synthetic peptide
  MOD_RES (2)..(5): Any amino acid
TXXXXR

SEQ ID NO: 4628 - protein, 3 aa, Artificial Sequence
  Description of Artificial Sequence: Synthetic peptide
  MOD_RES (2)..(2): Any amino acid
TXQ

SEQ ID NO: 4629 - protein, 4 aa, Artificial Sequence
  Description of Artificial Sequence: Synthetic peptide
  MOD_RES (2)..(3): Any amino acid
QXXL

SEQ ID NO: 4630 - protein, 5 aa, Artificial Sequence
  Description of Artificial Sequence: Synthetic peptide
  MOD_RES (2)..(4): Any amino acid
AXXXS

SEQ ID NO: 4631 - protein, 3 aa, Artificial Sequence
  Description of Artificial Sequence: Synthetic peptide
  MOD_RES (2)..(2): Any amino acid
YXY

SEQ ID NO: 4632 - protein, 5 aa, Artificial Sequence
  Description of Artificial Sequence: Synthetic peptide
  MOD_RES (2)..(4): Any amino acid
NXXXM

SEQ ID NO: 4633 - protein, 4 aa, Artificial Sequence
  Description of Artificial Sequence: Synthetic peptide
  MOD_RES (2)..(3): Any amino acid
NXXS

SEQ ID NO: 4634 - protein, 5 aa, Artificial Sequence
  Description of Artificial Sequence: Synthetic peptide
  MOD_RES (2)..(4): Any amino acid
PXXXQ

SEQ ID NO: 4635 - protein, 6 aa, Artificial Sequence
  Description of Artificial Sequence: Synthetic peptide
  MOD_RES (2)..(5): Any amino acid
RXXXXN

SEQ ID NO: 4636 - protein, 5 aa, Artificial Sequence
  Description of Artificial Sequence: Synthetic peptide
  MOD_RES (2)..(4): Any amino acid
SXXXS

SEQ ID NO: 4637 - protein, 5 aa, Artificial Sequence
  Description of Artificial Sequence: Synthetic peptide
  MOD_RES (2)..(4): Any amino acid
DXXXM

SEQ ID NO: 4638 - protein, 6 aa, Artificial Sequence
  Description of Artificial Sequence: Synthetic peptide
  MOD_RES (3)..(5): Any amino acid
REXXXR

SEQ ID NO: 4639 - protein, 5 aa, Artificial Sequence
  Description of Artificial Sequence: Synthetic peptide
  MOD_RES (2)..(4): Any amino acid
MXXXV

SEQ ID NO: 4640 - protein, 3 aa, Artificial Sequence
  Description of Artificial Sequence: Synthetic peptide
  MOD_RES (2)..(2): Any amino acid
NXN

SEQ ID NO: 4641 - protein, 3 aa, Artificial Sequence
  Description of Artificial Sequence: Synthetic peptide
  MOD_RES (2)..(2): Any amino acid
NXY

SEQ ID NO: 4642 - protein, 3 aa, Artificial Sequence
  Description of Artificial Sequence: Synthetic peptide
  MOD_RES (2)..(2): Any amino acid
TXW

SEQ ID NO: 4643 - protein, 5 aa, Artificial Sequence
  Description of Artificial Sequence: Synthetic peptide
  MOD_RES (2)..(4): Any amino acid
QXXXE

SEQ ID NO: 4644 - protein, 5 aa, Artificial Sequence
  Description of Artificial Sequence: Synthetic peptide
  MOD_RES (2)..(4): Any amino acid
NXXXD

SEQ ID NO: 4645 - protein, 5 aa, Artificial Sequence
  Description of Artificial Sequence: Synthetic peptide
  MOD_RES (2)..(3): Any amino acid
EXXRA

SEQ ID NO: 4646 - protein, 4 aa, Artificial Sequence
  Description of Artificial Sequence: Synthetic peptide
  MOD_RES (2)..(3): Any amino acid
QXXG

SEQ ID NO: 4647 - protein, 5 aa, Artificial Sequence
  Description of Artificial Sequence: Synthetic peptide
  MOD_RES (3)..(4): Any amino acid
PEXXA

SEQ ID NO: 4648 - protein, 5 aa, Artificial Sequence
  Description of Artificial Sequence: Synthetic peptide
  MOD_RES (3)..(4): Any amino acid
AAXXA

SEQ ID NO: 4649 - protein, 4 aa, Artificial Sequence
  Description of Artificial Sequence: Synthetic peptide
  MOD_RES (3)..(3): Any amino acid
LSXE

SEQ ID NO: 4650 - protein, 4 aa, Artificial Sequence
  Description of Artificial Sequence: Synthetic peptide
  MOD_RES (2)..(3): Any amino acid
NXXT

SEQ ID NO: 4651 - protein, 5 aa, Artificial Sequence
  Description of Artificial Sequence: Synthetic peptide
  MOD_RES (3)..(4): Any amino acid
LAXXR

SEQ ID NO: 4652 - protein, 4 aa, Artificial Sequence
  Description of Artificial Sequence: Synthetic peptide
  MOD_RES (2)..(3): Any amino acid
PXXR

SEQ ID NO: 4653 - protein, 5 aa, Artificial Sequence
  Description of Artificial Sequence: Synthetic peptide
  MOD_RES (2)..(4): Any amino acid
RXXXY

SEQ ID NO: 4654 - protein, 5 aa, Artificial Sequence
  Description of Artificial Sequence: Synthetic peptide
  MOD_RES (2)..(4): Any amino acid
NXXXS

SEQ ID NO: 4655 - protein, 3 aa, Artificial Sequence
  Description of Artificial Sequence: Synthetic peptide
ERG

SEQ ID NO: 4656 - protein, 5 aa, Artificial Sequence
  Description of Artificial Sequence: Synthetic peptide
  MOD_RES (2)..(4): Any amino acid
TXXXN

SEQ ID NO: 4657 - protein, 5 aa, Artificial Sequence
  Description of Artificial Sequence: Synthetic peptide
  MOD_RES (2)..(4): Any amino acid
EXXXN

SEQ ID NO: 4658 - protein, 4 aa, Artificial Sequence
  Description of Artificial Sequence: Synthetic peptide
  MOD_RES (2)..(3): Any amino acid
SXXG

SEQ ID NO: 4659 - protein, 5 aa, Artificial Sequence
  Description of Artificial Sequence: Synthetic peptide
  MOD_RES (2)..(4): Any amino acid
QXXXP

SEQ ID NO: 4660 - protein, 4 aa, Artificial Sequence
  Description of Artificial Sequence: Synthetic peptide
  MOD_RES (2)..(3): Any amino acid
QXXR

SEQ ID NO: 4661 - protein, 5 aa, Artificial Sequence
  Description of Artificial Sequence: Synthetic peptide
  MOD_RES (2)..(4): Any amino acid
HXXXV

SEQ ID NO: 4662 - protein, 5 aa, Artificial Sequence
  Description of Artificial Sequence: Synthetic peptide
  MOD_RES (2)..(4): Any amino acid
PXXXD

SEQ ID NO: 4663 - protein, 3 aa, Artificial Sequence
  Description of Artificial Sequence: Synthetic peptide
  MOD_RES (2)..(2): Any amino acid
DXA

SEQ ID NO: 4664 - protein, 5 aa, Artificial Sequence
  Description of Artificial Sequence: Synthetic peptide
  MOD_RES (2)..(4): Any amino acid
PXXXH

SEQ ID NO: 4665 - protein, 3 aa, Artificial Sequence
  Description of Artificial Sequence: Synthetic peptide
GFS

SEQ ID NO: 4666 - protein, 4 aa, Artificial Sequence
  Description of Artificial Sequence: Synthetic peptide
  MOD_RES (2)..(3): Any amino acid
EXXH

SEQ ID NO: 4667 - protein, 5 aa, Artificial Sequence
  Description of Artificial Sequence: Synthetic peptide
  MOD_RES (2)..(4): Any amino acid
VXXXR

SEQ ID NO: 4668 - protein, 2 aa, Artificial Sequence
  Description of Artificial Sequence: Synthetic peptide
NH

SEQ ID NO: 4669 - protein, 5 aa, Artificial Sequence
  Description of Artificial Sequence: Synthetic peptide
  MOD_RES (2)..(4): Any amino acid
EXXXS

SEQ ID NO: 4670 - protein, 3 aa, Artificial Sequence
  Description of Artificial Sequence: Synthetic peptide
  MOD_RES (2)..(2): Any amino acid
SXS

SEQ ID NO: 4671 - protein, 5 aa, Artificial Sequence
  Description of Artificial Sequence: Synthetic peptide
  MOD_RES (2)..(4): Any amino acid
GXXXH

SEQ ID NO: 4672 - protein, 5 aa, Artificial Sequence
  Description of Artificial Sequence: Synthetic peptide
  MOD_RES (2)..(4): Any amino acid
QXXXN

SEQ ID NO: 4673 - protein, 6 aa, Artificial Sequence
  Description of Artificial Sequence: Synthetic peptide
  MOD_RES (2)..(5): Any amino acid
RXXXXE

SEQ ID NO: 4674 - protein, 3 aa, Artificial Sequence
  Description of Artificial Sequence: Synthetic peptide
  MOD_RES (2)..(2): Any amino acid
AXP

SEQ ID NO: 4675 - protein, 4 aa, Artificial Sequence
  Description of Artificial Sequence: Synthetic peptide
  MOD_RES (2)..(3): Any amino acid
SXXE

SEQ ID NO: 4676 - protein, 3 aa, Artificial Sequence
  Description of Artificial Sequence: Synthetic peptide
  MOD_RES (2)..(2): Any amino acid
WXD

SEQ ID NO: 4677 - protein, 5 aa, Artificial Sequence
  Description of Artificial Sequence: Synthetic peptide
  MOD_RES (2)..(4): Any amino acid
EXXXA

SEQ ID NO: 4678 - protein, 5 aa, Artificial Sequence
  Description of Artificial Sequence: Synthetic peptide
  MOD_RES (2)..(4): Any amino acid
AXXXD

SEQ ID NO: 4679 - protein, 5 aa, Artificial Sequence
  Description of Artificial Sequence: Synthetic peptide
  MOD_RES (2)..(4): Any amino acid
LXXXE

SEQ ID NO: 4680 - protein, 5 aa, Artificial Sequence
  Description of Artificial Sequence: Synthetic peptide
  MOD_RES (2)..(4): Any amino acid
FXXXT

SEQ ID NO: 4681 - protein, 5 aa, Artificial Sequence
  Description of Artificial Sequence: Synthetic peptide
  MOD_RES (2)..(4): Any amino acid
SXXXS

SEQ ID NO: 4682 - protein, 6 aa, Artificial Sequence
  Description of Artificial Sequence: Synthetic peptide
  MOD_RES (2)..(5): Any amino acid
KXXXXS

SEQ ID NO: 4683 - protein, 4 aa, Artificial Sequence
  Description of Artificial Sequence: Synthetic peptide
  MOD_RES (3)..(3): Any amino acid
KKXG

SEQ ID NO: 4684 - protein, 3 aa, Artificial Sequence
  Description of Artificial Sequence: Synthetic peptide
  MOD_RES (2)..(2): Any amino acid
YXG

SEQ ID NO: 4685 - protein, 3 aa, Artificial Sequence
  Description of Artificial Sequence: Synthetic peptide
  MOD_RES (2)..(2): Any amino acid
NXR

SEQ ID NO: 4686 - protein, 4 aa, Artificial Sequence
  Description of Artificial Sequence: Synthetic peptide
  MOD_RES (2)..(3): Any amino acid
TXXR

SEQ ID NO: 4687 - protein, 5 aa, Artificial Sequence
  Description of Artificial Sequence: Synthetic peptide
  MOD_RES (2)..(4): Any amino acid
QXXXD

SEQ ID NO: 4688 - protein, 5 aa, Artificial Sequence
  Description of Artificial Sequence: Synthetic peptide
  MOD_RES (2)..(4): Any amino acid
PXXXV

SEQ ID NO: 4689 - protein, 5 aa, Artificial Sequence
  Description of Artificial Sequence: Synthetic peptide
  MOD_RES (2)..(4): Any amino acid
SXXXN

SEQ ID NO: 4690 - protein, 4 aa, Artificial Sequence
  Description of Artificial Sequence: Synthetic peptide
  MOD_RES (2)..(3): Any amino acid
LXXE

SEQ ID NO: 4691 - protein, 5 aa, Artificial Sequence
  Description of Artificial Sequence: Synthetic peptide
  MOD_RES (2)..(4): Any amino acid
SXXXA

SEQ ID NO: 4692 - protein, 5 aa, Artificial Sequence
  Description of Artificial Sequence: Synthetic peptide
  MOD_RES (2)..(4): Any amino acid
VXXXD

SEQ ID NO: 4693 - protein, 3 aa, Artificial Sequence
  Description of Artificial Sequence: Synthetic peptide
  MOD_RES (2)..(2): Any amino acid
TXR

SEQ ID NO: 4694 - protein, 5 aa, Artificial Sequence
  Description of Artificial Sequence: Synthetic peptide
  MOD_RES (2)..(4): Any amino acid
SXXXI

SEQ ID NO: 4695 - protein, 3 aa, Artificial Sequence
  Description of Artificial Sequence: Synthetic peptide
  MOD_RES (2)..(2): Any amino acid
QXI

SEQ ID NO: 4696 - protein, 5 aa, Artificial Sequence
  Description of Artificial Sequence: Synthetic peptide
  MOD_RES (2)..(4): Any amino acid
RXXXI

SEQ ID NO: 4697 - protein, 3 aa, Artificial Sequence
  Description of Artificial Sequence: Synthetic peptide
TKV

SEQ ID NO: 4698 - protein, 4 aa, Artificial Sequence
  Description of Artificial Sequence: Synthetic peptide
  MOD_RES (2)..(3): Any amino acid
PXXQ

SEQ ID NO: 4699 - protein, 3 aa, Artificial Sequence
  Description of Artificial Sequence: Synthetic peptide
  MOD_RES (2)..(2): Any amino acid
DXR

SEQ ID NO: 4700 - protein, 5 aa, Artificial Sequence
  Description of Artificial Sequence: Synthetic peptide
  MOD_RES (2)..(3): Any amino acid
EXXRE

SEQ ID NO: 4701 - protein, 6 aa, Artificial Sequence
  Description of Artificial Sequence: Synthetic peptide
  MOD_RES (2)..(5): Any amino acid
KXXXXE

SEQ ID NO: 4702 - protein, 5 aa, Artificial Sequence
  Description of Artificial Sequence: Synthetic peptide
  MOD_RES (2)..(4): Any amino acid
RXXXD

SEQ ID NO: 4703 - protein, 5 aa, Artificial Sequence
  Description of Artificial Sequence: Synthetic peptide
  MOD_RES (2)..(4): Any amino acid
RXXXV

SEQ ID NO: 4704 - protein, 5 aa, Artificial Sequence
  Description of Artificial Sequence: Synthetic peptide
  MOD_RES (2)..(4): Any amino acid
EXXXF

SEQ ID NO: 4705 - protein, 3 aa, Artificial Sequence
  Description of Artificial Sequence: Synthetic peptide
  MOD_RES (2)..(2): Any amino acid
GXW

SEQ ID NO: 4706 - protein, 2 aa, Artificial Sequence
  Description of Artificial Sequence: Synthetic peptide
QF

SEQ ID NO: 4707 - protein, 5 aa, Artificial Sequence
  Description of Artificial Sequence: Synthetic peptide
  MOD_RES (2)..(4): Any amino acid
MXXXD

SEQ ID NO: 4708 - protein, 5 aa, Artificial Sequence
  Description of Artificial Sequence: Synthetic peptide
  MOD_RES (2)..(4): Any amino acid
QXXXS

SEQ ID NO: 4709 - protein, 3 aa, Artificial Sequence
  Description of Artificial Sequence: Synthetic peptide
  MOD_RES (2)..(2): Any amino acid
SXN

SEQ ID NO: 4710 - protein, 5 aa, Artificial Sequence
  Description of Artificial Sequence: Synthetic peptide
  MOD_RES (2)..(4): Any amino acid
EXXXI

SEQ ID NO: 4711 - protein, 5 aa, Artificial Sequence
  Description of Artificial Sequence: Synthetic peptide
  MOD_RES (2)..(4): Any amino acid
LXXXR

SEQ ID NO: 4712 - protein, 5 aa, Artificial Sequence
  Description of Artificial Sequence: Synthetic peptide
  MOD_RES (2)..(4): Any amino acid
PXXXA

SEQ ID NO: 4713 - protein, 5 aa, Artificial Sequence
  Description of Artificial Sequence: Synthetic peptide
  MOD_RES (2)..(4): Any amino acid
EXXXH

SEQ ID NO: 4714 - protein, 4 aa, Artificial Sequence
  Description of Artificial Sequence: Synthetic peptide
  MOD_RES (2)..(3): Any amino acid
NXXR

SEQ ID NO: 4715 - protein, 4 aa, Artificial Sequence
  Description of Artificial Sequence: Synthetic peptide
  MOD_RES (2)..(3): Any amino acid
DXXR

SEQ ID NO: 4716 - protein, 5 aa, Artificial Sequence
  Description of Artificial Sequence: Synthetic peptide
  MOD_RES (2)..(4): Any amino acid
LXXXQ

SEQ ID NO: 4717 - protein, 5 aa, Artificial Sequence
  Description of Artificial Sequence: Synthetic peptide
  MOD_RES (2)..(3): Any amino acid
AXXRE

SEQ ID NO: 4718 - protein, 3 aa, Artificial Sequence
  Description of Artificial Sequence: Synthetic peptide
  MOD_RES (2)..(2): Any amino acid
NXQ

SEQ ID NO: 4719 - protein, 4 aa, Artificial Sequence
  Description of Artificial Sequence: Synthetic peptide
  MOD_RES (2)..(3): Any amino acid
NXXF

SEQ ID NO: 4720 - protein, 5 aa, Artificial Sequence
  Description of Artificial Sequence: Synthetic peptide
  MOD_RES (2)..(4): Any amino acid
MXXXE

SEQ ID NO: 4721 - protein, 5 aa, Artificial Sequence
  Description of Artificial Sequence: Synthetic peptide
  MOD_RES (2)..(4): Any amino acid
RXXXW

SEQ ID NO: 4722 - protein, 4 aa, Artificial Sequence
  Description of Artificial Sequence: Synthetic peptide
  MOD_RES (2)..(3): Any amino acid
DXXR

SEQ ID NO: 4723 - protein, 4 aa, Artificial Sequence
  Description of Artificial Sequence: Synthetic peptide
  MOD_RES (2)..(3): Any amino acid
RXXD

SEQ ID NO: 4724 - protein, 4 aa, Artificial Sequence
  Description of Artificial Sequence: Synthetic peptide
  MOD_RES (2)..(3): Any amino acid
NXXN

SEQ ID NO: 4725 - protein, 5 aa, Artificial Sequence
  Description of Artificial Sequence: Synthetic peptide
  MOD_RES (2)..(4): Any amino acid
TXXXD

SEQ ID NO: 4726 - protein, 5 aa, Artificial Sequence
  Description of Artificial Sequence: Synthetic peptide
  MOD_RES (2)..(4): Any amino acid
LXXXA

SEQ ID NO: 4727 - protein, 5 aa, Artificial Sequence
  Description of Artificial Sequence: Synthetic peptide
  MOD_RES (2)..(3): Any amino acid
EXXLA

SEQ ID NO: 4728 - protein, 3 aa, Artificial Sequence
  Description of Artificial Sequence: Synthetic peptide
  MOD_RES (2)..(2): Any amino acid
WXG

SEQ ID NO: 4729 - protein, 5 aa, Artificial Sequence
  Description of Artificial Sequence: Synthetic peptide
  MOD_RES (2)..(4): Any amino acid
QXXXR

SEQ ID NO: 4730 - protein, 5 aa, Artificial Sequence
  Description of Artificial Sequence: Synthetic peptide
  MOD_RES (3)..(4): Any amino acid
EQXXA

SEQ ID NO: 4731 - protein, 5 aa, Artificial Sequence
  Description of Artificial Sequence: Synthetic peptide
  MOD_RES (2)..(4): Any amino acid
RXXXK

SEQ ID NO: 4732 - protein, 5 aa, Artificial Sequence
  Description of Artificial Sequence: Synthetic peptide
  MOD_RES (2)..(4): Any amino acid
MXXXQ

SEQ ID NO: 4733 - protein, 6 aa, Artificial Sequence
  Description of Artificial Sequence: Synthetic peptide
  MOD_RES (2)..(5): Any amino acid
SXXXXN

SEQ ID NO: 4734 - protein, 4 aa, Artificial Sequence
  Description of Artificial Sequence: Synthetic peptide
  MOD_RES (2)..(3): Any amino acid
QXXN

SEQ ID NO: 4735 - protein, 4 aa, Artificial Sequence
  Description of Artificial Sequence: Synthetic peptide
  MOD_RES (2)..(3): Any amino acid
NXXA

SEQ ID NO: 4736 - protein, 5 aa, Artificial Sequence
  Description of Artificial Sequence: Synthetic peptide
  MOD_RES (2)..(4): Any amino acid
SXXXV

SEQ ID NO: 4737 - protein, 3 aa, Artificial Sequence
  Description of Artificial Sequence: Synthetic peptide
  MOD_RES (2)..(2): Any amino acid
EXW

SEQ ID NO: 4738 - protein, 5 aa, Artificial Sequence
  Description of Artificial Sequence: Synthetic peptide
  MOD_RES (2)..(4): Any amino acid
AXXXN

SEQ ID NO: 4739 - protein, 5 aa, Artificial Sequence
  Description of Artificial Sequence: Synthetic peptide
  MOD_RES (2)..(4): Any amino acid
RXXXN

SEQ ID NO: 4740 - protein, 3 aa, Artificial Sequence
  Description of Artificial Sequence: Synthetic peptide
YPE

SEQ ID NO: 4741 - protein, 5 aa, Artificial Sequence
  Description of Artificial Sequence: Synthetic peptide
  MOD_RES (3)..(4): Any amino acid
EEXXS

SEQ ID NO: 4742 - protein, 5 aa, Artificial Sequence
  Description of Artificial Sequence: Synthetic peptide
  MOD_RES (2)..(4): Any amino acid
TXXXM

SEQ ID NO: 4743 - protein, 6 aa, Artificial Sequence
  Description of Artificial Sequence: Synthetic peptide
  MOD_RES (2)..(5): Any amino acid
EXXXXR

SEQ ID NO: 4744 - protein, 3 aa, Artificial Sequence
  Description of Artificial Sequence: Synthetic peptide
  MOD_RES (2)..(2): Any amino acid
LXS

SEQ ID NO: 4745 - protein, 5 aa, Artificial Sequence
  Description of Artificial Sequence: Synthetic peptide
  MOD_RES (3)..(4): Any amino acid
REXXR

SEQ ID NO: 4746 - protein, 3 aa, Artificial Sequence
  Description of Artificial Sequence: Synthetic peptide
  MOD_RES (2)..(2): Any amino acid
SXT

SEQ ID NO: 4747 - protein, 5 aa, Artificial Sequence
  Description of Artificial Sequence: Synthetic peptide
  MOD_RES (2)..(3): Any amino acid
AXXEA

SEQ ID NO: 4748 - protein, 4 aa, Artificial Sequence
  Description of Artificial Sequence: Synthetic peptide
  MOD_RES (2)..(3): Any amino acid
PXXV

SEQ ID NO: 4749 - protein, 3 aa, Artificial Sequence
  Description of Artificial Sequence: Synthetic peptide
  MOD_RES (2)..(2): Any amino acid
EXR

SEQ ID NO: 4750 - protein, 5 aa, Artificial Sequence
  Description of Artificial Sequence: Synthetic peptide
  MOD_RES (2)..(4): Any amino acid
GXXXS

SEQ ID NO: 4751 - protein, 4 aa, Artificial Sequence
  Description of Artificial Sequence: Synthetic peptide
  MOD_RES (2)..(3): Any amino acid
TXXE

SEQ ID NO: 4752 - protein, 5 aa, Artificial Sequence
  Description of Artificial Sequence: Synthetic peptide
  MOD_RES (2)..(4): Any amino acid
QXXXP

SEQ ID NO: 4753 - protein, 3 aa, Artificial Sequence
  Description of Artificial Sequence: Synthetic peptide
TGP

SEQ ID NO: 4754 - protein, 4 aa, Artificial Sequence
  Description of Artificial Sequence: Synthetic peptide
  MOD_RES (2)..(3): Any amino acid
NXXE

SEQ ID NO: 4755 - protein, 4 aa, Artificial Sequence
  Description of Artificial Sequence: Synthetic peptide
  MOD_RES (2)..(3): Any amino acid
SXXT

SEQ ID NO: 4756 - protein, 5 aa, Artificial Sequence
  Description of Artificial Sequence: Synthetic peptide
  MOD_RES (2)..(4): Any amino acid
DXXXQ

SEQ ID NO: 4757 - protein, 6 aa, Artificial Sequence
  Description of Artificial Sequence: Synthetic peptide
  MOD_RES (2)..(5): Any amino acid
RXXXXN

SEQ ID NO: 4758 - protein, 5 aa, Artificial Sequence
  Description of Artificial Sequence: Synthetic peptide
  MOD_RES (2)..(4): Any amino acid
EXXXL

SEQ ID NO: 4759 - protein, 6 aa, Artificial Sequence
  Description of Artificial Sequence: Synthetic peptide
  MOD_RES (2)..(5): Any amino acid
SXXXXQ

SEQ ID NO: 4760 - protein, 5 aa, Artificial Sequence
  Description of Artificial Sequence: Synthetic peptide
  MOD_RES (2)..(4): Any amino acid
YXXXI

SEQ ID NO: 4761 - protein, 3 aa, Artificial Sequence
  Description of Artificial Sequence: Synthetic peptide
  MOD_RES (2)..(2): Any amino acid
SXR

SEQ ID NO: 4762 - protein, 5 aa, Artificial Sequence
  Description of Artificial Sequence: Synthetic peptide
  MOD_RES (3)..(4): Any amino acid
EEXXR

SEQ ID NO: 4763 - protein, 4 aa, Artificial Sequence
  Description of Artificial Sequence: Synthetic peptide
  MOD_RES (2)..(3): Any amino acid
QXXY

SEQ ID NO: 4764 - protein, 5 aa, Artificial Sequence
  Description of Artificial Sequence: Synthetic peptide
  MOD_RES (2)..(4): Any amino acid
KXXXF

SEQ ID NO: 4765 - protein, 5 aa, Artificial Sequence
  Description of Artificial Sequence: Synthetic peptide
  MOD_RES (2)..(3): Any amino acid
EXXAA

SEQ ID NO: 4766 - protein, 3 aa, Artificial Sequence
  Description of Artificial Sequence: Synthetic peptide
SGY

SEQ ID NO: 4767 - protein, 5 aa, Artificial Sequence
  Description of Artificial Sequence: Synthetic peptide
  MOD_RES (2)..(4): Any amino acid
AXXXA

SEQ ID NO: 4768 - protein, 6 aa, Artificial Sequence
  Description of Artificial Sequence: Synthetic peptide
  MOD_RES (2)..(5): Any amino acid
RXXXXK

SEQ ID NO: 4769 - protein, 5 aa, Artificial Sequence
  Description of Artificial Sequence: Synthetic peptide
  MOD_RES (2)..(4): Any amino acid
AXXXA

SEQ ID NO: 4770 - protein, 5 aa, Artificial Sequence
  Description of Artificial Sequence: Synthetic peptide
  MOD_RES (2)..(4): Any amino acid
DXXXN

SEQ ID NO: 4771 - protein, 6 aa, Artificial Sequence
  Description of Artificial Sequence: Synthetic peptide
  MOD_RES (2)..(5): Any amino acid
KXXXXD

SEQ ID NO: 4772 - protein, 5 aa, Artificial Sequence
  Description of Artificial Sequence: Synthetic peptide
  MOD_RES (2)..(3): Any amino acid
AXXLA

SEQ ID NO: 4773 - protein, 5 aa, Artificial Sequence
  Description of Artificial Sequence: Synthetic peptide
  MOD_RES (2)..(4): Any amino acid
QXXXL

SEQ ID NO: 4774 - protein, 4 aa, Artificial Sequence
  Description of Artificial Sequence: Synthetic peptide
  MOD_RES (2)..(3): Any amino acid
TXXG

SEQ ID NO: 4775 - protein, 4 aa, Artificial Sequence
  Description of Artificial Sequence: Synthetic peptide
  MOD_RES (2)..(3): Any amino acid
PXXR

SEQ ID NO: 4776 - protein, 5 aa, Artificial Sequence
  Description of Artificial Sequence: Synthetic peptide
  MOD_RES (3)..(4): Any amino acid
DAXXA

SEQ ID NO: 4777 - protein, 4 aa, Artificial Sequence
  Description of Artificial Sequence: Synthetic peptide
  MOD_RES (2)..(3): Any amino acid
TXXE

SEQ ID NO: 4778 - protein, 5 aa, Artificial Sequence
  Description of Artificial Sequence: Synthetic peptide
  MOD_RES (2)..(4): Any amino acid
HXXXK

SEQ ID NO: 4779 - protein, 5 aa, Artificial Sequence
  Description of Artificial Sequence: Synthetic peptide
  MOD_RES (2)..(4): Any amino acid
TXXXI

SEQ ID NO: 4780 - protein, 5 aa, Artificial Sequence
  Description of Artificial Sequence: Synthetic peptide
  MOD_RES (2)..(4): Any amino acid
EXXXH

SEQ ID NO: 4781 - protein, 3 aa, Artificial Sequence
  Description of Artificial Sequence: Synthetic peptide
  MOD_RES (2)..(2): Any amino acid
HXY

SEQ ID NO: 4782 - protein, 4 aa, Artificial Sequence
  Description of Artificial Sequence: Synthetic peptide
  MOD_RES (2)..(3): Any amino acid
SXXY

SEQ ID NO: 4783 - protein, 3 aa, Artificial Sequence
  Description of Artificial Sequence: Synthetic peptide
  MOD_RES (2)..(2): Any amino acid
SXH

SEQ ID NO: 4784 - protein, 4 aa, Artificial Sequence
  Description of Artificial Sequence: Synthetic peptide
  MOD_RES (2)..(3): Any amino acid
HXXH

SEQ ID NO: 4785 - protein, 5 aa, Artificial Sequence
  Description of Artificial Sequence: Synthetic peptide
  MOD_RES (2)..(4): Any amino acid
TXXXA

SEQ ID NO: 4786 - protein, 2 aa, Artificial Sequence
  Description of Artificial Sequence: Synthetic peptide
YQ

SEQ ID NO: 4787 - protein, 3 aa, Artificial Sequence
  Description of Artificial Sequence: Synthetic peptide
KVD

SEQ ID NO: 4788 - protein, 4 aa, Artificial Sequence
  Description of Artificial Sequence: Synthetic peptide
  MOD_RES (2)..(3): Any amino acid
DXXG

SEQ ID NO: 4789 - protein, 4 aa, Artificial Sequence
  Description of Artificial Sequence: Synthetic peptide
  MOD_RES (2)..(3): Any amino acid
AXXG

SEQ ID NO: 4790 - protein, 5 aa, Artificial Sequence
  Description of Artificial Sequence: Synthetic peptide
  MOD_RES (2)..(4): Any amino acid
RXXXD

SEQ ID NO: 4791 - protein, 3 aa, Artificial Sequence
  Description of Artificial Sequence: Synthetic peptide
  MOD_RES (2)..(2): Any amino acid
DXS

SEQ ID NO: 4792 - protein, 5 aa, Artificial Sequence
  Description of Artificial Sequence: Synthetic peptide
  MOD_RES (2)..(4): Any amino acid
DXXXS

SEQ ID NO: 4793 - protein, 5 aa, Artificial Sequence
  Description of Artificial Sequence: Synthetic peptide
  MOD_RES (3)..(4): Any amino acid
RAXXA

SEQ ID NO: 4794 - protein, 3 aa, Artificial Sequence
  Description of Artificial Sequence: Synthetic peptide
GLN

SEQ ID NO: 4795 - protein, 3 aa, Artificial Sequence
  Description of Artificial Sequence: Synthetic peptide
  MOD_RES (2)..(2): Any amino acid
NXG

SEQ ID NO: 4796 - protein, 3 aa, Artificial Sequence
  Description of Artificial Sequence: Synthetic peptide
  MOD_RES (2)..(2): Any amino acid
SXN

SEQ ID NO: 4797 - protein, 4 aa, Artificial Sequence
  Description of Artificial Sequence: Synthetic peptide
  MOD_RES (2)..(3): Any amino acid
SXXN

SEQ ID NO: 4798 - protein, 4 aa, Artificial Sequence
  Description of Artificial Sequence: Synthetic peptide
  MOD_RES (2)..(3): Any amino acid
HXXR

SEQ ID NO: 4799 - protein, 4 aa, Artificial Sequence
  Description of Artificial Sequence: Synthetic peptide
  MOD_RES (2)..(2): Any amino acid
PXGP

SEQ ID NO: 4800 - protein, 4 aa, Artificial Sequence
  Description of Artificial Sequence: Synthetic peptide
  MOD_RES (2)..(3): Any amino acid
DXXS

SEQ ID NO: 4801 - protein, 2 aa, Artificial Sequence
  Description of Artificial Sequence: Synthetic peptide
PF

SEQ ID NO: 4802 - protein, 5 aa, Artificial Sequence
  Description of Artificial Sequence: Synthetic peptide
  MOD_RES (2)..(4): Any amino acid
DXXXN

SEQ ID NO: 4803 - protein, 6 aa, Artificial Sequence
  Description of Artificial Sequence: Synthetic peptide
  MOD_RES (2)..(5): Any amino acid
DXXXXR

SEQ ID NO: 4804 - protein, 3 aa, Artificial Sequence
  Description of Artificial Sequence: Synthetic peptide
  MOD_RES (2)..(2): Any amino acid
LXA

SEQ ID NO: 4805 - protein, 5 aa, Artificial Sequence
  Description of Artificial Sequence: Synthetic peptide
  MOD_RES (3)..(4): Any amino acid
AEXXR

SEQ ID NO: 4806 - protein, 3 aa, Artificial Sequence
  Description of Artificial Sequence: Synthetic peptide
  MOD_RES (2)..(2): Any amino acid
EXF

SEQ ID NO: 4807 - protein, 5 aa, Artificial Sequence
  Description of Artificial Sequence: Synthetic peptide
  MOD_RES (2)..(4): Any amino acid
VXXXT

SEQ ID NO: 4808 - protein, 5 aa, Artificial Sequence
  Description of Artificial Sequence: Synthetic peptide
  MOD_RES (2)..(4): Any amino acid
MXXXK

SEQ ID NO: 4809 - protein, 3 aa, Artificial Sequence
  Description of Artificial Sequence: Synthetic peptide
  MOD_RES (2)..(2): Any amino acid
SXQ

SEQ ID NO: 4810 - protein, 5 aa, Artificial Sequence
  Description of Artificial Sequence: Synthetic peptide
  MOD_RES (2)..(4): Any amino acid
KXXXR

SEQ ID NO: 4811 - protein, 3 aa, Artificial Sequence
  Description of Artificial Sequence: Synthetic peptide
GFT

SEQ ID NO: 4812 - protein, 5 aa, Artificial Sequence
  Description of Artificial Sequence: Synthetic peptide
  MOD_RES (2)..(4): Any amino acid
LXXXM

SEQ ID NO: 4813 - protein, 5 aa, Artificial Sequence
  Description of Artificial Sequence: Synthetic peptide
  MOD_RES (2)..(4): Any amino acid
SXXXE

SEQ ID NO: 4814 - protein, 4 aa, Artificial Sequence
  Description of Artificial Sequence: Synthetic peptide
  MOD_RES (2)..(3): Any amino acid
FXXG

SEQ ID NO: 4815 - protein, 5 aa, Artificial Sequence
  Description of Artificial Sequence: Synthetic peptide
  MOD_RES (3)..(4): Any amino acid
AAXXE

SEQ ID NO: 4816 - protein, 5 aa, Artificial Sequence
  Description of Artificial Sequence: Synthetic peptide
  MOD_RES (2)..(4): Any amino acid
DXXXA

SEQ ID NO: 4817 - protein, 6 aa, Artificial Sequence
  Description of Artificial Sequence: Synthetic peptide
  MOD_RES (2)..(5): Any amino acid
KXXXXE

SEQ ID NO: 4818 - protein, 5 aa, Artificial Sequence
  Description of Artificial Sequence: Synthetic peptide
  MOD_RES (2)..(4): Any amino acid
EXXXE

SEQ ID NO: 4819 - protein, 5 aa, Artificial Sequence
  Description of Artificial Sequence: Synthetic peptide
  MOD_RES (2)..(4): Any amino acid
AXXXG

SEQ ID NO: 4820 - protein, 3 aa, Artificial Sequence
  Description of Artificial Sequence: Synthetic peptide
GYS

SEQ ID NO: 4821 - protein, 5 aa, Artificial Sequence
  Description of Artificial Sequence: Synthetic peptide
  MOD_RES (2)..(4): Any amino acid
VXXXH

SEQ ID NO: 4822 - protein, 3 aa, Artificial Sequence
  Description of Artificial Sequence: Synthetic peptide
  MOD_RES (2)..(2): Any amino acid
YXP

SEQ ID NO: 4823 - protein, 4 aa, Artificial Sequence
  Description of Artificial Sequence: Synthetic peptide
  MOD_RES (2)..(3): Any amino acid
FXXQ

SEQ ID NO: 4824 - protein, 3 aa, Artificial Sequence
  Description of Artificial Sequence: Synthetic peptide
  MOD_RES (2)..(2): Any amino acid
DXQ

SEQ ID NO: 4825 - protein, 6 aa, Artificial Sequence
  Description of Artificial Sequence: Synthetic peptide
  MOD_RES (2)..(5): Any amino acid
PXXXXE

SEQ ID NO: 4826 - protein, 4 aa, Artificial Sequence
  Description of Artificial Sequence: Synthetic peptide
  MOD_RES (2)..(3): Any amino acid
NXXF

SEQ ID NO: 4827 - protein, 5 aa, Artificial Sequence
  Description of Artificial Sequence: Synthetic peptide
  MOD_RES (2)..(4): Any amino acid
KXXXG

SEQ ID NO: 4828 - protein, 5 aa, Artificial Sequence
  Description of Artificial Sequence: Synthetic peptide
  MOD_RES (2)..(4): Any amino acid
TXXXS

SEQ ID NO: 4829 - protein, 5 aa, Artificial Sequence
  Description of Artificial Sequence: Synthetic peptide
  MOD_RES (2)..(4): Any amino acid
MXXXS

SEQ ID NO: 4830 - protein, 3 aa, Artificial Sequence
  Description of Artificial Sequence: Synthetic peptide
  MOD_RES (2)..(2): Any amino acid
SXT

SEQ ID NO: 4831 - protein, 5 aa, Artificial Sequence
  Description of Artificial Sequence: Synthetic peptide
  MOD_RES (2)..(4): Any amino acid
DXXXE

SEQ ID NO: 4832 - protein, 4 aa, Artificial Sequence
  Description of Artificial Sequence: Synthetic peptide
  MOD_RES (3)..(3): Any amino acid
KEXG

SEQ ID NO: 4833 - protein, 3 aa, Artificial Sequence
  Description of Artificial Sequence: Synthetic peptide
YPG

SEQ ID NO: 4834 - protein, 2 aa, Artificial Sequence
  Description of Artificial Sequence: Synthetic peptide
EF

SEQ ID NO: 4835 - protein, 3 aa, Artificial Sequence
  Description of Artificial Sequence: Synthetic peptide
  MOD_RES (2)..(2): Any amino acid
RXD

SEQ ID NO: 4836 - protein, 4 aa, Artificial Sequence
  Description of Artificial Sequence: Synthetic peptide
  MOD_RES (2)..(3): Any amino acid
NXXG

SEQ ID NO: 4837 - protein, 4 aa, Artificial Sequence
  Description of Artificial Sequence: Synthetic peptide
  MOD_RES (2)..(3): Any amino acid
PXXR

SEQ ID NO: 4838 - protein, 4 aa, Artificial Sequence
  Description of Artificial Sequence: Synthetic peptide
  MOD_RES (2)..(3): Any amino acid
RXXG

SEQ ID NO: 4839 - protein, 5 aa, Artificial Sequence
  Description of Artificial Sequence: Synthetic peptide
  MOD_RES (2)..(4): Any amino acid
PXXXQ

SEQ ID NO: 4840 - protein, 6 aa, Artificial Sequence
  Description of Artificial Sequence: Synthetic peptide
  MOD_RES (2)..(5): Any amino acid
PXXXXL

SEQ ID NO: 4841 - protein, 5 aa, Artificial Sequence
  Description of Artificial Sequence: Synthetic peptide
  MOD_RES (2)..(4): Any amino acid
NXXXA

SEQ ID NO: 4842 - protein, 3 aa, Artificial Sequence
  Description of Artificial Sequence: Synthetic peptide
  MOD_RES (2)..(2): Any amino acid
LXQ

SEQ ID NO: 4843 - protein, 4 aa, Artificial Sequence
  Description of Artificial Sequence: Synthetic peptide
  MOD_RES (2)..(3): Any amino acid
SXXN

SEQ ID NO: 4844 - protein, 5 aa, Artificial Sequence
  Description of Artificial Sequence: Synthetic peptide
  MOD_RES (2)..(4): Any amino acid
EXXXN

SEQ ID NO: 4845 - protein, 4 aa, Artificial Sequence
  Description of Artificial Sequence: Synthetic peptide
  MOD_RES (2)..(3): Any amino acid
NXXD

SEQ ID NO: 4846 - protein, 3 aa, Artificial Sequence
  Description of Artificial Sequence: Synthetic peptide
  MOD_RES (2)..(2): Any amino acid
PXH

SEQ ID NO: 4847 - protein, 4 aa, Artificial Sequence
  Description of Artificial Sequence: Synthetic peptide
  MOD_RES (2)..(3): Any amino acid
HXXQ

SEQ ID NO: 4848 - protein, 2 aa, Artificial Sequence
  Description of Artificial Sequence: Synthetic peptide
RF

SEQ ID NO: 4849 - protein, 5 aa, Artificial Sequence
  Description of Artificial Sequence: Synthetic peptide
  MOD_RES (2)..(4): Any amino acid
SXXXE

SEQ ID NO: 4850 - protein, 5 aa, Artificial Sequence
  Description of Artificial Sequence: Synthetic peptide
  MOD_RES (2)..(4): Any amino acid
GXXXR

SEQ ID NO: 4851 - protein, 3 aa, Artificial Sequence
  Description of Artificial Sequence: Synthetic peptide
  MOD_RES (2)..(2): Any amino acid
RXY

SEQ ID NO: 4852 - protein, 3 aa, Artificial Sequence
  Description of Artificial Sequence: Synthetic peptide
  MOD_RES (2)..(2): Any amino acid
SXE

SEQ ID NO: 4853 - protein, 4 aa, Artificial Sequence
  Description of Artificial Sequence: Synthetic peptide
  MOD_RES (2)..(3): Any amino acid
DXXF

SEQ ID NO: 4854 - protein, 5 aa, Artificial Sequence
  Description of Artificial Sequence: Synthetic peptide
  MOD_RES (3)..(4): Any amino acid
RLXXE

SEQ ID NO: 4855 - protein, 4 aa, Artificial Sequence
  Description of Artificial Sequence: Synthetic peptide
  MOD_RES (2)..(3): Any amino acid
RXXR

SEQ ID NO: 4856 - protein, 3 aa, Artificial Sequence
  Description of Artificial Sequence: Synthetic peptide
  MOD_RES (2)..(2): Any amino acid
TXY

SEQ ID NO: 4857 - protein, 5 aa, Artificial Sequence
  Description of Artificial Sequence: Synthetic peptide
  MOD_RES (2)..(4): Any amino acid
DXXXD

SEQ ID NO: 4858 - protein, 5 aa, Artificial Sequence
  Description of Artificial Sequence: Synthetic peptide
  MOD_RES (2)..(4): Any amino acid
AXXXP

SEQ ID NO: 4859 - protein, 6 aa, Artificial Sequence
  Description of Artificial Sequence: Synthetic peptide
  MOD_RES (2)..(5): Any amino acid
RXXXXG

SEQ ID NO: 4860 - protein, 5 aa, Artificial Sequence
  Description of Artificial Sequence: Synthetic peptide
  MOD_RES (2)..(4): Any amino acid
NXXXE

SEQ ID NO: 4861 - protein, 5 aa, Artificial Sequence
  Description of Artificial Sequence: Synthetic peptide
  MOD_RES (2)..(4): Any amino acid
QXXXG

SEQ ID NO: 4862 - protein, 3 aa, Artificial Sequence
  Description of Artificial Sequence: Synthetic peptide
  MOD_RES (2)..(2): Any amino acid
PXS

SEQ ID NO: 4863 - protein, 4 aa, Artificial Sequence
  Description of Artificial Sequence: Synthetic peptide
  MOD_RES (2)..(3): Any amino acid
NXXR

SEQ ID NO: 4864 - protein, 4 aa, Artificial Sequence
  Description of Artificial Sequence: Synthetic peptide
  MOD_RES (2)..(3): Any amino acid
PXXK

SEQ ID NO: 4865 - protein, 4 aa, Artificial Sequence
  Description of Artificial Sequence: Synthetic peptide
  MOD_RES (2)..(3): Any amino acid
YXXE

SEQ ID NO: 4866 - protein, 4 aa, Artificial Sequence
  Description of Artificial Sequence: Synthetic peptide
  MOD_RES (2)..(2): Any amino acid
SXEE

SEQ ID NO: 4867 - protein, 2 aa, Artificial Sequence
  Description of Artificial Sequence: Synthetic peptide
QY

SEQ ID NO: 4868 - protein, 4 aa, Artificial Sequence
  Description of Artificial Sequence: Synthetic peptide
  MOD_RES (2)..(3): Any amino acid
GXXA

SEQ ID NO: 4869 - protein, 3 aa, Artificial Sequence
  Description of Artificial Sequence: Synthetic peptide
  MOD_RES (2)..(2): Any amino acid
YXR

SEQ ID NO: 4870 - protein, 2 aa, Artificial Sequence
  Description of Artificial Sequence: Synthetic peptide
RH

SEQ ID NO: 4871 - protein, 3 aa, Artificial Sequence
  Description of Artificial Sequence: Synthetic peptide
  MOD_RES (2)..(2): Any amino acid
RXE

SEQ ID NO: 4872 - protein, 4 aa, Artificial Sequence
  Description of Artificial Sequence: Synthetic peptide
  MOD_RES (2)..(3): Any amino acid
SXXQ

SEQ ID NO: 4873 - protein, 5 aa, Artificial Sequence
  Description of Artificial Sequence: Synthetic peptide
  MOD_RES (2)..(4): Any amino acid
NXXXE

SEQ ID NO: 4874 - protein, 4 aa, Artificial Sequence
  Description of Artificial Sequence: Synthetic peptide
  MOD_RES (2)..(3): Any amino acid
RXXG

SEQ ID NO: 4875 - protein, 5 aa, Artificial Sequence
  Description of Artificial Sequence: Synthetic peptide
  MOD_RES (3)..(4): Any amino acid
ERXXA

SEQ ID NO: 4876 - protein, 4 aa, Artificial Sequence
  Description of Artificial Sequence: Synthetic peptide
  MOD_RES (2)..(3): Any amino acid
DXXD

SEQ ID NO: 4877 - protein, 3 aa, Artificial Sequence
  Description of Artificial Sequence: Synthetic peptide
  MOD_RES (2)..(2): Any amino acid
RXE

SEQ ID NO: 4878 - protein, 5 aa, Artificial Sequence
  Description of Artificial Sequence: Synthetic peptide
  MOD_RES (2)..(4): Any amino acid
TXXXE

SEQ ID NO: 4879 - protein, 3 aa, Artificial Sequence
  Description of Artificial Sequence: Synthetic peptide
  MOD_RES (2)..(2): Any amino acid
FXF

SEQ ID NO: 4880 - protein, 5 aa, Artificial Sequence
  Description of Artificial Sequence: Synthetic peptide
  MOD_RES (2)..(4): Any amino acid
DXXXY

SEQ ID NO: 4881 - protein, 5 aa, Artificial Sequence
  Description of Artificial Sequence: Synthetic peptide
  MOD_RES (2)..(4): Any amino acid
KXXXL

SEQ ID NO: 4882 - protein, 3 aa, Artificial Sequence
  Description of Artificial Sequence: Synthetic peptide
TPG

SEQ ID NO: 4883 - protein, 5 aa, Artificial Sequence
  Description of Artificial Sequence: Synthetic peptide
  MOD_RES (2)..(4): Any amino acid
GXXXD

SEQ ID NO: 4884 - protein, 5 aa, Artificial Sequence
  Description of Artificial Sequence: Synthetic peptide
  MOD_RES (2)..(3): Any amino acid
AXXEE

SEQ ID NO: 4885 - protein, 3 aa, Artificial Sequence
  Description of Artificial Sequence: Synthetic peptide
  MOD_RES (2)..(2): Any amino acid
PXQ

SEQ ID NO: 4886 - protein, 5 aa, Artificial Sequence
  Description of Artificial Sequence: Synthetic peptide
  MOD_RES (2)..(4): Any amino acid
RXXXP

SEQ ID NO: 4887 - protein, 5 aa, Artificial Sequence
  Description of Artificial Sequence: Synthetic peptide
  MOD_RES (2)..(4): Any amino acid
AXXXF

SEQ ID NO: 4888 - protein, 5 aa, Artificial Sequence
  Description of Artificial Sequence: Synthetic peptide
  MOD_RES (2)..(4): Any amino acid
SXXXG

SEQ ID NO: 4889 - protein, 4 aa, Artificial Sequence
  Description of Artificial Sequence: Synthetic peptide
  MOD_RES (2)..(3): Any amino acid
DXXQ

SEQ ID NO: 4890 - protein, 4 aa, Artificial Sequence
  Description of Artificial Sequence: Synthetic peptide
  MOD_RES (2)..(3): Any amino acid
WXXS

SEQ ID NO: 4891 - protein, 5 aa, Artificial Sequence
  Description of Artificial Sequence: Synthetic peptide
  MOD_RES (2)..(4): Any amino acid
GXXXQ

SEQ ID NO: 4892 - protein, 5 aa, Artificial Sequence
  Description of Artificial Sequence: Synthetic peptide
  MOD_RES (2)..(4): Any amino acid
RXXXR

SEQ ID NO: 4893 - protein, 5 aa, Artificial Sequence
  Description of Artificial Sequence: Synthetic peptide
  MOD_RES (2)..(3): Any amino acid
RXXEA

SEQ ID NO: 4894 - protein, 3 aa, Artificial Sequence
  Description of Artificial Sequence: Synthetic peptide
  MOD_RES (2)..(2): Any amino acid
SXG

SEQ ID NO: 4895 - protein, 5 aa, Artificial Sequence
  Description of Artificial Sequence: Synthetic peptide
  MOD_RES (2)..(4): Any amino acid
GXXXQ

SEQ ID NO: 4896 - protein, 4 aa, Artificial Sequence
  Description of Artificial Sequence: Synthetic peptide
  MOD_RES (2)..(3): Any amino acid
SXXL

SEQ ID NO: 4897 - protein, 5 aa, Artificial Sequence
  Description of Artificial Sequence: Synthetic peptide
  MOD_RES (2)..(4): Any amino acid
HXXXS

SEQ ID NO: 4898 - protein, 5 aa, Artificial Sequence
  Description of Artificial Sequence: Synthetic peptide
  MOD_RES (2)..(4): Any amino acid
EXXXL

SEQ ID NO: 4899 - protein, 5 aa, Artificial Sequence
  Description of Artificial Sequence: Synthetic peptide
  MOD_RES (2)..(4): Any amino acid
EXXXL

SEQ ID NO: 4900 - protein, 3 aa, Artificial Sequence
  Description of Artificial Sequence: Synthetic peptide
  MOD_RES (2)..(2): Any amino acid
YXP

SEQ ID NO: 4901 - protein, 3 aa, Artificial Sequence
  Description of Artificial Sequence: Synthetic peptide
VDK

SEQ ID NO: 4902 - protein, 4 aa, Artificial Sequence
  Description of Artificial Sequence: Synthetic peptide
  MOD_RES (2)..(3): Any amino acid
SXXY

SEQ ID NO: 4903 - protein, 4 aa, Artificial Sequence
  Description of Artificial Sequence: Synthetic peptide
  MOD_RES (2)..(3): Any amino acid
DXXY

SEQ ID NO: 4904 - protein, 3 aa, Artificial Sequence
  Description of Artificial Sequence: Synthetic peptide
  MOD_RES (2)..(2): Any amino acid
LXV

SEQ ID NO: 4905 - protein, 3 aa, Artificial Sequence
  Description of Artificial Sequence: Synthetic peptide
  MOD_RES (2)..(2): Any amino acid
PXY

SEQ ID NO: 4906 - protein, 5 aa, Artificial Sequence
  Description of Artificial Sequence: Synthetic peptide
  MOD_RES (2)..(4): Any amino acid
EXXXV

SEQ ID NO: 4907 - protein, 3 aa, Artificial Sequence
  Description of Artificial Sequence: Synthetic peptide
  MOD_RES (2)..(2): Any amino acid
GXG

SEQ ID NO: 4908 - protein, 5 aa, Artificial Sequence
  Description of Artificial Sequence: Synthetic peptide
  MOD_RES (2)..(4): Any amino acid
DXXXG

SEQ ID NO: 4909 - protein, 3 aa, Artificial Sequence
  Description of Artificial Sequence: Synthetic peptide
  MOD_RES (2)..(2): Any amino acid
SXG

SEQ ID NO: 4910 - protein, 5 aa, Artificial Sequence
  Description of Artificial Sequence: Synthetic peptide
  MOD_RES (2)..(4): Any amino acid
FXXXG

SEQ ID NO: 4911 - protein, 3 aa, Artificial Sequence
  Description of Artificial Sequence: Synthetic peptide
  MOD_RES (2)..(2): Any amino acid
YXE

SEQ ID NO: 4912 - protein, 5 aa, Artificial Sequence
  Description of Artificial Sequence: Synthetic peptide
  MOD_RES (2)..(4): Any amino acid
KXXXN

SEQ ID NO: 4913 - protein, 6 aa, Artificial Sequence
  Description of Artificial Sequence: Synthetic peptide
  MOD_RES (2)..(5): Any amino acid
NXXXXK

SEQ ID NO: 4914 - protein, 5 aa, Artificial Sequence
  Description of Artificial Sequence: Synthetic peptide
  MOD_RES (2)..(4): Any amino acid
RXXXA

SEQ ID NO: 4915 - protein, 4 aa, Artificial Sequence
  Description of Artificial Sequence: Synthetic peptide
  MOD_RES (2)..(3): Any amino acid
QXXN

SEQ ID NO: 4916 - protein, 5 aa, Artificial Sequence
  Description of Artificial Sequence: Synthetic peptide
  MOD_RES (3)..(4): Any amino acid
EEXXA

SEQ ID NO: 4917 - protein, 5 aa, Artificial Sequence
  Description of Artificial Sequence: Synthetic peptide
  MOD_RES (2)..(4): Any amino acid
EXXXD

SEQ ID NO: 4918 - protein, 4 aa, Artificial Sequence
  Description of Artificial Sequence: Synthetic peptide
  MOD_RES (2)..(3): Any amino acid
NXXQ

SEQ ID NO: 4919 - protein, 5 aa, Artificial Sequence
  Description of Artificial Sequence: Synthetic peptide
  MOD_RES (2)..(4): Any amino acid
LXXXD

SEQ ID NO: 4920 - protein, 5 aa, Artificial Sequence
  Description of Artificial Sequence: Synthetic peptide
  MOD_RES (2)..(4): Any amino acid
AXXXT

SEQ ID NO: 4921 - protein, 5 aa, Artificial Sequence
  Description of Artificial Sequence: Synthetic peptide
  MOD_RES (2)..(4): Any amino acid
NXXXV

SEQ ID NO: 4922 - protein, 3 aa, Artificial Sequence
  Description of Artificial Sequence: Synthetic peptide
  MOD_RES (2)..(2): Any amino acid
AXG

SEQ ID NO: 4923 - protein, 5 aa, Artificial Sequence
  Description of Artificial Sequence: Synthetic peptide
  MOD_RES (2)..(4): Any amino acid
SXXXD

SEQ ID NO: 4924 - protein, 4 aa, Artificial Sequence
  Description of Artificial Sequence: Synthetic peptide
  MOD_RES (2)..(3): Any amino acid
NXXS

SEQ ID NO: 4925 - protein, 5 aa, Artificial Sequence
  Description of Artificial Sequence: Synthetic peptide
  MOD_RES (2)..(4): Any amino acid
LXXXS

SEQ ID NO: 4926 - protein, 4 aa, Artificial Sequence
  Description of Artificial Sequence: Synthetic peptide
  MOD_RES (2)..(3): Any amino acid
DXXH

SEQ ID NO: 4927 - protein, 4 aa, Artificial Sequence
  Description of Artificial Sequence: Synthetic peptide
  MOD_RES (2)..(3): Any amino acid
GXXE

SEQ ID NO: 4928 - protein, 4 aa, Artificial Sequence
  Description of Artificial Sequence: Synthetic peptide
  MOD_RES (2)..(3): Any amino acid
SXXR

SEQ ID NO: 4929 - protein, 3 aa, Artificial Sequence
  Description of Artificial Sequence: Synthetic peptide
  MOD_RES (2)..(2): Any amino acid
TXE

SEQ ID NO: 4930 - protein, 4 aa, Artificial Sequence
  Description of Artificial Sequence: Synthetic peptide
  MOD_RES (2)..(3): Any amino acid
RXXQ

SEQ ID NO: 4931 - protein, 4 aa, Artificial Sequence
  Description of Artificial Sequence: Synthetic peptide
  MOD_RES (2)..(3): Any amino acid
DXXG

SEQ ID NO: 4932 - protein, 3 aa, Artificial Sequence
  Description of Artificial Sequence: Synthetic peptide
  MOD_RES (2)..(2): Any amino acid
NXG

SEQ ID NO: 4933 - protein, 5 aa, Artificial Sequence
  Description of Artificial Sequence: Synthetic peptide
  MOD_RES (2)..(4): Any amino acid
EXXXP

SEQ ID NO: 4934 - protein, 3 aa, Artificial Sequence
  Description of Artificial Sequence: Synthetic peptide
  MOD_RES (2)..(2): Any amino acid
EXR

SEQ ID NO: 4935 - protein, 5 aa, Artificial Sequence
  Description of Artificial Sequence: Synthetic peptide
  MOD_RES (2)..(4): Any amino acid
EXXXS

SEQ ID NO: 4936 - protein, 4 aa, Artificial Sequence
  Description of Artificial Sequence: Synthetic peptide
  MOD_RES (2)..(3): Any amino acid
TXXN

SEQ ID NO: 4937 - protein, 2 aa, Artificial Sequence
  Description of Artificial Sequence: Synthetic peptide
RY

SEQ ID NO: 4938 - protein, 3 aa, Artificial Sequence
  Description of Artificial Sequence: Synthetic peptide
  MOD_RES (2)..(2): Any amino acid
PXD

SEQ ID NO: 4939 - protein, 4 aa, Artificial Sequence
  Description of Artificial Sequence: Synthetic peptide
  MOD_RES (2)..(3): Any amino acid
RXXR

SEQ ID NO: 4940 - protein, 4 aa, Artificial Sequence
  Description of Artificial Sequence: Synthetic peptide
  MOD_RES (2)..(3): Any amino acid
PXXE

SEQ ID NO: 4941 - protein, 5 aa, Artificial Sequence
  Description of Artificial Sequence: Synthetic peptide
  MOD_RES (2)..(4): Any amino acid
RXXXS

SEQ ID NO: 4942 - protein, 4 aa, Artificial Sequence
  Description of Artificial Sequence: Synthetic peptide
  MOD_RES (2)..(3): Any amino acid
GXXN

SEQ ID NO: 4943 - protein, 5 aa, Artificial Sequence
  Description of Artificial Sequence: Synthetic peptide
  MOD_RES (2)..(4): Any amino acid
RXXXQ

SEQ ID NO: 4944 - protein, 5 aa, Artificial Sequence
  Description of Artificial Sequence: Synthetic peptide
  MOD_RES (2)..(4): Any amino acid
TXXXT

SEQ ID NO: 4945 - protein, 4 aa, Artificial Sequence
  Description of Artificial Sequence: Synthetic peptide
  MOD_RES (2)..(3): Any amino acid
YXXS

SEQ ID NO: 4946 - protein, 5 aa, Artificial Sequence
  Description of Artificial Sequence: Synthetic peptide
  MOD_RES (2)..(4): Any amino acid
EXXXA

SEQ ID NO: 4947 - protein, 2 aa, Artificial Sequence
  Description of Artificial Sequence: Synthetic peptide
NY

SEQ ID NO: 4948 - protein, 4 aa, Artificial Sequence
  Description of Artificial Sequence: Synthetic peptide
  MOD_RES (2)..(3): Any amino acid
LXXQ

SEQ ID NO: 4949 - protein, 3 aa, Artificial Sequence
  Description of Artificial Sequence: Synthetic peptide
  MOD_RES (2)..(2): Any amino acid
RXF

SEQ ID NO: 4950 - protein, 5 aa, Artificial Sequence
  Description of Artificial Sequence: Synthetic peptide
  MOD_RES (2)..(4): Any amino acid
GXXXT

SEQ ID NO: 4951 - protein, 3 aa, Artificial Sequence
  Description of Artificial Sequence: Synthetic peptide
  MOD_RES (2)..(2): Any amino acid
DXS

SEQ ID NO: 4952 - protein, 5 aa, Artificial Sequence
  Description of Artificial Sequence: Synthetic peptide
  MOD_RES (2)..(4): Any amino acid
EXXXT

SEQ ID NO: 4953 - protein, 5 aa, Artificial Sequence
  Description of Artificial Sequence: Synthetic peptide
  MOD_RES (2)..(4): Any amino acid
SXXXY

SEQ ID NO: 4954 - protein, 5 aa, Artificial Sequence
  Description of Artificial Sequence: Synthetic peptide
  MOD_RES (2)..(4): Any amino acid
RXXXT

SEQ ID NO: 4955 - protein, 5 aa, Artificial Sequence
  Description of Artificial Sequence: Synthetic peptide
  MOD_RES (2)..(4): Any amino acid
RXXXG

SEQ ID NO: 4956 - protein, 5 aa, Artificial Sequence
  Description of Artificial Sequence: Synthetic peptide
  MOD_RES (2)..(4): Any amino acid
LXXXT

SEQ ID NO: 4957 - protein, 5 aa, Artificial Sequence
  Description of Artificial Sequence: Synthetic peptide
  MOD_RES (2)..(4): Any amino acid
DXXXT

SEQ ID NO: 4958 - protein, 5 aa, Artificial Sequence
  Description of Artificial Sequence: Synthetic peptide
  MOD_RES (2)..(4): Any amino acid
AXXXS

SEQ ID NO: 4959 - protein, 3 aa, Artificial Sequence
  Description of Artificial Sequence: Synthetic peptide
  MOD_RES (2)..(2): Any amino acid
TXN

SEQ ID NO: 4960 - protein, 5 aa, Artificial Sequence
  Description of Artificial Sequence: Synthetic peptide
  MOD_RES (2)..(4): Any amino acid
DXXXH

SEQ ID NO: 4961 - protein, 5 aa, Artificial Sequence
  Description of Artificial Sequence: Synthetic peptide
  MOD_RES (2)..(4): Any amino acid
PXXXA

SEQ ID NO: 4962 - protein, 4 aa, Artificial Sequence
  Description of Artificial Sequence: Synthetic peptide
  MOD_RES (2)..(3): Any amino acid
EXXQ

SEQ ID NO: 4963 - protein, 3 aa, Artificial Sequence
  Description of Artificial Sequence: Synthetic peptide
  MOD_RES (2)..(2): Any amino acid
DXR

SEQ ID NO: 4964 - protein, 5 aa, Artificial Sequence
  Description of Artificial Sequence: Synthetic peptide
  MOD_RES (2)..(4): Any amino acid
VXXXG

SEQ ID NO: 4965 - protein, 5 aa, Artificial Sequence
  Description of Artificial Sequence: Synthetic peptide
  MOD_RES (2)..(4): Any amino acid
AXXXE

SEQ ID NO: 4966 - protein, 4 aa, Artificial Sequence
  Description of Artificial Sequence: Synthetic peptide
  MOD_RES (2)..(3): Any amino acid
DXXL

SEQ ID NO: 4967 - protein, 5 aa, Artificial Sequence
  Description of Artificial Sequence: Synthetic peptide
  MOD_RES (2)..(4): Any amino acid
EXXXG

SEQ ID NO: 4968 - protein, 4 aa, Artificial Sequence
  Description of Artificial Sequence: Synthetic peptide
  MOD_RES (2)..(3): Any amino acid
SXXR

SEQ ID NO: 4969 - protein, 4 aa, Artificial Sequence
  Description of Artificial Sequence: Synthetic peptide
  MOD_RES (2)..(3): Any amino acid
YXXR

SEQ ID NO: 4970 - protein, 5 aa, Artificial Sequence
  Description of Artificial Sequence: Synthetic peptide
  MOD_RES (2)..(4): Any amino acid
MXXXA

SEQ ID NO: 4971 - protein, 5 aa, Artificial Sequence
  Description of Artificial Sequence: Synthetic peptide
  MOD_RES (2)..(4): Any amino acid
KXXXQ

SEQ ID NO: 4972 - protein, 3 aa, Artificial Sequence
  Description of Artificial Sequence: Synthetic peptide
  MOD_RES (2)..(2): Any amino acid
LXP

SEQ ID NO: 4973 - protein, 3 aa, Artificial Sequence
  Description of Artificial Sequence: Synthetic peptide
  MOD_RES (2)..(2): Any amino acid
NXQ

SEQ ID NO: 4974 - protein, 5 aa, Artificial Sequence
  Description of Artificial Sequence: Synthetic peptide
  MOD_RES (2)..(4): Any amino acid
KXXXY

SEQ ID NO: 4975 - protein, 5 aa, Artificial Sequence
  Description of Artificial Sequence: Synthetic peptide
  MOD_RES (3)..(4): Any amino acid
AEXXA

SEQ ID NO: 4976 - protein, 3 aa, Artificial Sequence
  Description of Artificial Sequence: Synthetic peptide
  MOD_RES (2)..(2): Any amino acid
QXP

SEQ ID NO: 4977 - protein, 3 aa, Artificial Sequence
  Description of Artificial Sequence: Synthetic peptide
SLP

SEQ ID NO: 4978 - protein, 3 aa, Artificial Sequence
  Description of Artificial Sequence: Synthetic peptide
  MOD_RES (2)..(2): Any amino acid
FXP

SEQ ID NO: 4979 - protein, 5 aa, Artificial Sequence
  Description of Artificial Sequence: Synthetic peptide
  MOD_RES (2)..(4): Any amino acid
PXXXE

SEQ ID NO: 4980 - protein, 3 aa, Artificial Sequence
  Description of Artificial Sequence: Synthetic peptide
  MOD_RES (2)..(2): Any amino acid
DXF

SEQ ID NO: 4981 - protein, 3 aa, Artificial Sequence
  Description of Artificial Sequence: Synthetic peptide
  MOD_RES (2)..(2): Any amino acid
DXR

SEQ ID NO: 4982 - protein, 4 aa, Artificial Sequence
  Description of Artificial Sequence: Synthetic peptide
  MOD_RES (2)..(3): Any amino acid
YXXG

SEQ ID NO: 4983 - protein, 5 aa, Artificial Sequence
  Description of Artificial Sequence: Synthetic peptide
  MOD_RES (2)..(4): Any amino acid
EXXXQ

SEQ ID NO: 4984 - protein, 4 aa, Artificial Sequence
  Description of Artificial Sequence: Synthetic peptide
  MOD_RES (2)..(3): Any amino acid
EXXR

SEQ ID NO: 4985 - protein, 4 aa, Artificial Sequence
  Description of Artificial Sequence: Synthetic peptide
  MOD_RES (2)..(3): Any amino acid
SXXD

SEQ ID NO: 4986 - protein, 5 aa, Artificial Sequence
  Description of Artificial Sequence: Synthetic peptide
  MOD_RES (2)..(4): Any amino acid
RXXXS

SEQ ID NO: 4987 - protein, 3 aa, Artificial Sequence
  Description of Artificial Sequence: Synthetic peptide
VPG

SEQ ID NO: 4988 - protein, 5 aa, Artificial Sequence
  Description of Artificial Sequence: Synthetic peptide
  MOD_RES (2)..(4): Any amino acid
KXXXE

SEQ ID NO: 4989 - protein, 2 aa, Artificial Sequence
  Description of Artificial Sequence: Synthetic peptide
CS

SEQ ID NO: 4990 - protein, 3 aa, Artificial Sequence
  Description of Artificial Sequence: Synthetic peptide
  MOD_RES (2)..(2): Any amino acid
DXN

SEQ ID NO: 4991 - protein, 4 aa, Artificial Sequence
  Description of Artificial Sequence: Synthetic peptide
  MOD_RES (2)..(3): Any amino acid
AXXR

SEQ ID NO: 4992 - protein, 4 aa, Artificial Sequence
  Description of Artificial Sequence: Synthetic peptide
  MOD_RES (2)..(3): Any amino acid
FXXS

SEQ ID NO: 4993 - protein, 4 aa, Artificial Sequence
  Description of Artificial Sequence: Synthetic peptide
  MOD_RES (2)..(3): Any amino acid
QXXG

SEQ ID NO: 4994 - protein, 4 aa, Artificial Sequence
  Description of Artificial Sequence: Synthetic peptide
  MOD_RES (2)..(3): Any amino acid
HXXE

SEQ ID NO: 4995 - protein, 4 aa, Artificial Sequence
  Description of Artificial Sequence: Synthetic peptide
  MOD_RES (2)..(3): Any amino acid
EXXG

SEQ ID NO: 4996 - protein, 5 aa, Artificial Sequence
  Description of Artificial Sequence: Synthetic peptide
  MOD_RES (2)..(4): Any amino acid
TXXXH

SEQ ID NO: 4997 - protein, 5 aa, Artificial Sequence
  Description of Artificial Sequence: Synthetic peptide
  MOD_RES (2)..(4): Any amino acid
LXXXD

SEQ ID NO: 4998 - protein, 5 aa, Artificial Sequence
  Description of Artificial Sequence: Synthetic peptide
  MOD_RES (2)..(4): Any amino acid
AXXXH

SEQ ID NO: 4999 - protein, 5 aa, Artificial Sequence
  Description of Artificial Sequence: Synthetic peptide
  MOD_RES (2)..(4): Any amino acid
DXXXV

SEQ ID NO: 5000 - protein, 5 aa, Artificial Sequence
  Description of Artificial Sequence: Synthetic peptide
  MOD_RES (2)..(4): Any amino acid
KXXXH

SEQ ID NO: 5001 - protein, 5 aa, Artificial Sequence
  Description of Artificial Sequence: Synthetic peptide
  MOD_RES (2)..(4): Any amino acid
SXXXQ

SEQ ID NO: 5002 - protein, 5 aa, Artificial Sequence
  Description of Artificial Sequence: Synthetic peptide
  MOD_RES (2)..(4): Any amino acid
QXXXA

SEQ ID NO: 5003 - protein, 5 aa, Artificial Sequence
  Description of Artificial Sequence: Synthetic peptide
  MOD_RES (2)..(4): Any amino acid
KXXXD

SEQ ID NO: 5004 - protein, 4 aa, Artificial Sequence
  Description of Artificial Sequence: Synthetic peptide
  MOD_RES (2)..(3): Any amino acid
QXXI

SEQ ID NO: 5005 - protein, 6 aa, Artificial Sequence
  Description of Artificial Sequence: Synthetic peptide
  MOD_RES (2)..(5): Any amino acid
EXXXXP

SEQ ID NO: 5006 - protein, 3 aa, Artificial Sequence
  Description of Artificial Sequence: Synthetic peptide
  MOD_RES (2)..(2): Any amino acid
YXS

SEQ ID NO: 5007 - protein, 5 aa, Artificial Sequence
  Description of Artificial Sequence: Synthetic peptide
  MOD_RES (2)..(3): Any amino acid
RXXEE

SEQ ID NO: 5008 - protein, 5 aa, Artificial Sequence
  Description of Artificial Sequence: Synthetic peptide
  MOD_RES (2)..(4): Any amino acid
KXXXE

SEQ ID NO: 5009 - protein, 4 aa, Artificial Sequence
  Description of Artificial Sequence: Synthetic peptide
  MOD_RES (2)..(3): Any amino acid
DXXH

SEQ ID NO: 5010 - protein, 4 aa, Artificial Sequence
  Description of Artificial Sequence: Synthetic peptide
  MOD_RES (2)..(3): Any amino acid
PXXN

SEQ ID NO: 5011 - protein, 4 aa, Artificial Sequence
  Description of Artificial Sequence: Synthetic peptide
  MOD_RES (2)..(3): Any amino acid
DXXR

SEQ ID NO: 5012 - protein, 5 aa, Artificial Sequence
  Description of Artificial Sequence: Synthetic peptide
  MOD_RES (2)..(4): Any amino acid
EXXXT

SEQ ID NO: 5013 - protein, 4 aa, Artificial Sequence
  Description of Artificial Sequence: Synthetic peptide
  MOD_RES (2)..(3): Any amino acid
PXXQ

SEQ ID NO: 5014 - protein, 3 aa, Artificial Sequence
  Description of Artificial Sequence: Synthetic peptide
  MOD_RES (2)..(2): Any amino acid
RXR

SEQ ID NO: 5015 - protein, 5 aa, Artificial Sequence
  Description of Artificial Sequence: Synthetic peptide
  MOD_RES (2)..(4): Any amino acid
AXXXM

SEQ ID NO: 5016 - protein, 3 aa, Artificial Sequence
  Description of Artificial Sequence: Synthetic peptide
  MOD_RES (2)..(2): Any amino acid
TXR

SEQ ID NO: 5017 - protein, 5 aa, Artificial Sequence
  Description of Artificial Sequence: Synthetic peptide
  MOD_RES (2)..(4): Any amino acid
KXXXN

SEQ ID NO: 5018 - protein, 3 aa, Artificial Sequence
  Description of Artificial Sequence: Synthetic peptide
  MOD_RES (2)..(2): Any amino acid
NXG

SEQ ID NO: 5019 - protein, 4 aa, Artificial Sequence
  Description of Artificial Sequence: Synthetic peptide
  MOD_RES (2)..(3): Any amino acid
RXXD

SEQ ID NO: 5020 - protein, 5 aa, Artificial Sequence
  Description of Artificial Sequence: Synthetic peptide
  MOD_RES (2)..(4): Any amino acid
KXXXM

SEQ ID NO: 5021 - protein, 6 aa, Artificial Sequence
  Description of Artificial Sequence: Synthetic peptide
  MOD_RES (2)..(5): Any amino acid
SXXXXL

SEQ ID NO: 5022 - protein, 5 aa, Artificial Sequence
  Description of Artificial Sequence: Synthetic peptide
  MOD_RES (2)..(3): Any amino acid
EXXAR

SEQ ID NO: 5023 - protein, 3 aa, Artificial Sequence
  Description of Artificial Sequence: Synthetic peptide
  MOD_RES (2)..(2): Any amino acid
QXD

SEQ ID NO: 5024 - protein, 4 aa, Artificial Sequence
  Description of Artificial Sequence: Synthetic peptide
  MOD_RES (2)..(2): Any amino acid
TXEE

SEQ ID NO: 5025 - protein, 5 aa, Artificial Sequence
  Description of Artificial Sequence: Synthetic peptide
  MOD_RES (2)..(4): Any amino acid
TXXXL

SEQ ID NO: 5026 - protein, 5 aa, Artificial Sequence
  Description of Artificial Sequence: Synthetic peptide
  MOD_RES (2)..(4): Any amino acid
EXXXM

SEQ ID NO: 5027 - protein, 5 aa, Artificial Sequence
  Description of Artificial Sequence: Synthetic peptide
  MOD_RES (2)..(4): Any amino acid
MXXXL

SEQ ID NO: 5028 - protein, 4 aa, Artificial Sequence
  Description of Artificial Sequence: Synthetic peptide
  MOD_RES (2)..(3): Any amino acid
YXXD

SEQ ID NO: 5029 - protein, 2 aa, Artificial Sequence
  Description of Artificial Sequence: Synthetic peptide
KY

SEQ ID NO: 5030 - protein, 3 aa, Artificial Sequence
  Description of Artificial Sequence: Synthetic peptide
  MOD_RES (2)..(2): Any amino acid
RXP

SEQ ID NO: 5031 - protein, 3 aa, Artificial Sequence
  Description of Artificial Sequence: Synthetic peptide
GLP

SEQ ID NO: 5032 - protein, 5 aa, Artificial Sequence
  Description of Artificial Sequence: Synthetic peptide
  MOD_RES (2)..(4): Any amino acid
SXXXT

SEQ ID NO: 5033 - protein, 3 aa, Artificial Sequence
  Description of Artificial Sequence: Synthetic peptide
  MOD_RES (2)..(2): Any amino acid
TXS

SEQ ID NO: 5034 - protein, 3 aa, Artificial Sequence
  Description of Artificial Sequence: Synthetic peptide
  MOD_RES (2)..(2): Any amino acid
NXE

SEQ ID NO: 5035 - protein, 4 aa, Artificial Sequence
  Description of Artificial Sequence: Synthetic peptide
  MOD_RES (2)..(3): Any amino acid
DXXE

SEQ ID NO: 5036 - protein, 5 aa, Artificial Sequence
  Description of Artificial Sequence: Synthetic peptide
  MOD_RES (2)..(4): Any amino acid
QXXXV

SEQ ID NO: 5037 - protein, 3 aa, Artificial Sequence
  Description of Artificial Sequence: Synthetic peptide
  MOD_RES (2)..(2): Any amino acid
GXV

SEQ ID NO: 5038 - protein, 3 aa, Artificial Sequence
  Description of Artificial Sequence: Synthetic peptide
  MOD_RES (2)..(2): Any amino acid
PXA

SEQ ID NO: 5039 - protein, 4 aa, Artificial Sequence
  Description of Artificial Sequence: Synthetic peptide
  MOD_RES (2)..(3): Any amino acid
RXXQ

SEQ ID NO: 5040 - protein, 3 aa, Artificial Sequence
  Description of Artificial Sequence: Synthetic peptide
  MOD_RES (2)..(2): Any amino acid
NXS

SEQ ID NO: 5041 - protein, 3 aa, Artificial Sequence
  Description of Artificial Sequence: Synthetic peptide
LPP

SEQ ID NO: 5042 - protein, 3 aa, Artificial Sequence
  Description of Artificial Sequence: Synthetic peptide
  MOD_RES (2)..(2): Any amino acid
RXN

SEQ ID NO: 5043 - protein, 5 aa, Artificial Sequence
  Description of Artificial Sequence: Synthetic peptide
  MOD_RES (2)..(4): Any amino acid
IXXXK

SEQ ID NO: 5044 - protein, 4 aa, Artificial Sequence
  Description of Artificial Sequence: Synthetic peptide
  MOD_RES (2)..(3): Any amino acid
QXXH

SEQ ID NO: 5045 - protein, 3 aa, Artificial Sequence
  Description of Artificial Sequence: Synthetic peptide
  MOD_RES (2)..(2): Any amino acid
RXQ

SEQ ID NO: 5046 - protein, 5 aa, Artificial Sequence
  Description of Artificial Sequence: Synthetic peptide
  MOD_RES (2)..(4): Any amino acid
DXXXE

SEQ ID NO: 5047 - protein, 5 aa, Artificial Sequence
  Description of Artificial Sequence: Synthetic peptide
  MOD_RES (2)..(4): Any amino acid
NXXXG

SEQ ID NO: 5048 - protein, 4 aa, Artificial Sequence
  Description of Artificial Sequence: Synthetic peptide
  MOD_RES (2)..(3): Any amino acid
PXXG

SEQ ID NO: 5049 - protein, 5 aa, Artificial Sequence
  Description of Artificial Sequence: Synthetic peptide
  MOD_RES (2)..(4): Any amino acid
DXXXA

SEQ ID NO: 5050 - protein, 2 aa, Artificial Sequence
  Description of Artificial Sequence: Synthetic peptide
LY

SEQ ID NO: 5051 - protein, 4 aa, Artificial Sequence
  Description of Artificial Sequence: Synthetic peptide
  MOD_RES (2)..(3): Any amino acid
PXXL

SEQ ID NO: 5052 - protein, 5 aa, Artificial Sequence
  Description of Artificial Sequence: Synthetic peptide
  MOD_RES (2)..(4): Any amino acid
VXXXF

SEQ ID NO: 5053 - protein, 3 aa, Artificial Sequence
  Description of Artificial Sequence: Synthetic peptide
  MOD_RES (2)..(2): Any amino acid
DXS

SEQ ID NO: 5054 - protein, 5 aa, Artificial Sequence
  Description of Artificial Sequence: Synthetic peptide
  MOD_RES (2)..(3): Any amino acid
EXXLE

SEQ ID NO: 5055 - protein, 4 aa, Artificial Sequence
  Description of Artificial Sequence: Synthetic peptide
  MOD_RES (2)..(3): Any amino acid
NXXP

SEQ ID NO: 5056 - protein, 3 aa, Artificial Sequence
  Description of Artificial Sequence: Synthetic peptide
  MOD_RES (2)..(2): Any amino acid
QXG

SEQ ID NO: 5057 - protein, 5 aa, Artificial Sequence
  Description of Artificial Sequence: Synthetic peptide
  MOD_RES (2)..(4): Any amino acid
AXXXL

SEQ ID NO: 5058 - protein, 3 aa, Artificial Sequence
  Description of Artificial Sequence: Synthetic peptide
  MOD_RES (2)..(2): Any amino acid
TXP

SEQ ID NO: 5059 - protein, 3 aa, Artificial Sequence
  Description of Artificial Sequence: Synthetic peptide
ALP

SEQ ID NO: 5060 - protein, 4 aa, Artificial Sequence
  Description of Artificial Sequence: Synthetic peptide
  MOD_RES (2)..(3): Any amino acid
YXXG

SEQ ID NO: 5061 - protein, 4 aa, Artificial Sequence
  Description of Artificial Sequence: Synthetic peptide
  MOD_RES (2)..(3): Any amino acid
DXXT

SEQ ID NO: 5062 - protein, 3 aa, Artificial Sequence
  Description of Artificial Sequence: Synthetic peptide
  MOD_RES (2)..(2): Any amino acid
YXF

SEQ ID NO: 5063 - protein, 4 aa, Artificial Sequence
  Description of Artificial Sequence: Synthetic peptide
  MOD_RES (2)..(3): Any amino acid
SXXA

SEQ ID NO: 5064 - protein, 3 aa, Artificial Sequence
  Description of Artificial Sequence: Synthetic peptide
  MOD_RES (2)..(2): Any amino acid
FXI

SEQ ID NO: 5065 - protein, 4 aa, Artificial Sequence
  Description of Artificial Sequence: Synthetic peptide
  MOD_RES (2)..(3): Any amino acid
DXXN

SEQ ID NO: 5066 - protein, 4 aa, Artificial Sequence
  Description of Artificial Sequence: Synthetic peptide
  MOD_RES (2)..(3): Any amino acid
DXXA

SEQ ID NO: 5067 - protein, 3 aa, Artificial Sequence
  Description of Artificial Sequence: Synthetic peptide
  MOD_RES (2)..(2): Any amino acid
LXL

SEQ ID NO: 5068 - protein, 5 aa, Artificial Sequence
  Description of Artificial Sequence: Synthetic peptide
  MOD_RES (2)..(4): Any amino acid
IXXXY

SEQ ID NO: 5069 - protein, 4 aa, Artificial Sequence
  Description of Artificial Sequence: Synthetic peptide
  MOD_RES (2)..(3): Any amino acid
KXXG

SEQ ID NO: 5070 - protein, 3 aa, Artificial Sequence
  Description of Artificial Sequence: Synthetic peptide
  MOD_RES (2)..(2): Any amino acid
FXS

SEQ ID NO: 5071 - protein, 2 aa, Artificial Sequence
  Description of Artificial Sequence: Synthetic peptide
QH

SEQ ID NO: 5072 - protein, 6 aa, Artificial Sequence
  Description of Artificial Sequence: Synthetic peptide
  MOD_RES (2)..(5): Any amino acid
TXXXXE

SEQ ID NO: 5073 - protein, 5 aa, Artificial Sequence
  Description of Artificial Sequence: Synthetic peptide
  MOD_RES (2)..(3): Any amino acid
AXXKA

SEQ ID NO: 5074 - protein, 4 aa, Artificial Sequence
  Description of Artificial Sequence: Synthetic peptide
  MOD_RES (2)..(3): Any amino acid
QXXQ

SEQ ID NO: 5075 - protein, 6 aa, Artificial Sequence
  Description of Artificial Sequence: Synthetic peptide
  MOD_RES (2)..(5): Any amino acid
PXXXXR

SEQ ID NO: 5076 - protein, 5 aa, Artificial Sequence
  Description of Artificial Sequence: Synthetic peptide
  MOD_RES (2)..(4): Any amino acid
AXXXY

SEQ ID NO: 5077 - protein, 4 aa, Artificial Sequence
  Description of Artificial Sequence: Synthetic peptide
  MOD_RES (2)..(3): Any amino acid
GXXG

SEQ ID NO: 5078 - protein, 4 aa, Artificial Sequence
  Description of Artificial Sequence: Synthetic peptide
  MOD_RES (2)..(3): Any amino acid
WXXR

SEQ ID NO: 5079 - protein, 3 aa, Artificial Sequence
  Description of Artificial Sequence: Synthetic peptide
  MOD_RES (2)..(2): Any amino acid
YXP

SEQ ID NO: 5080 - protein, 6 aa, Artificial Sequence
  Description of Artificial Sequence: Synthetic peptide
  MOD_RES (2)..(5): Any amino acid
TXXXXK

SEQ ID NO: 5081 - protein, 3 aa, Artificial Sequence
  Description of Artificial Sequence: Synthetic peptide
  MOD_RES (2)..(2): Any amino acid
SXL

SEQ ID NO: 5082 - protein, 3 aa, Artificial Sequence
  Description of Artificial Sequence: Synthetic peptide
  MOD_RES (2)..(2): Any amino acid
FXY

SEQ ID NO: 5083 - protein, 3 aa, Artificial Sequence
  Description of Artificial Sequence: Synthetic peptide
  MOD_RES (2)..(2): Any amino acid
PXA

SEQ ID NO: 5084 - protein, 4 aa, Artificial Sequence
  Description of Artificial Sequence: Synthetic peptide
  MOD_RES (2)..(3): Any amino acid
EXXY

SEQ ID NO: 5085 - protein, 2 aa, Artificial Sequence
  Description of Artificial Sequence: Synthetic peptide
EH

SEQ ID NO: 5086 - protein, 3 aa, Artificial Sequence
  Description of Artificial Sequence: Synthetic peptide
  MOD_RES (2)..(2): Any amino acid
HXE

SEQ ID NO: 5087 - protein, 3 aa, Artificial Sequence
  Description of Artificial Sequence: Synthetic peptide
  MOD_RES (2)..(2): Any amino acid
SXV

SEQ ID NO: 5088 - protein, 2 aa, Artificial Sequence
  Description of Artificial Sequence: Synthetic peptide
FG

SEQ ID NO: 5089 - protein, 3 aa, Artificial Sequence
  Description of Artificial Sequence: Synthetic peptide
  MOD_RES (2)..(2): Any amino acid
PXE

SEQ ID NO: 5090 - protein, 2 aa, Artificial Sequence
  Description of Artificial Sequence: Synthetic peptide
YN

SEQ ID NO: 5091 - protein, 4 aa, Artificial Sequence
  Description of Artificial Sequence: Synthetic peptide
  MOD_RES (2)..(3): Any amino acid
TXXG

SEQ ID NO: 5092 - protein, 3 aa, Artificial Sequence
  Description of Artificial Sequence: Synthetic peptide
PGD

SEQ ID NO: 5093 - protein, 5 aa, Artificial Sequence
  Description of Artificial Sequence: Synthetic peptide
  MOD_RES (2)..(4): Any amino acid
KXXXP

SEQ ID NO: 5094 - protein, 3 aa, Artificial Sequence
  Description of Artificial Sequence: Synthetic peptide
  MOD_RES (2)..(2): Any amino acid
SXG

SEQ ID NO: 5095 - protein, 4 aa, Artificial Sequence
  Description of Artificial Sequence: Synthetic peptide
  MOD_RES (2)..(3): Any amino acid
FXXE

SEQ ID NO: 5096 - protein, 3 aa, Artificial Sequence
  Description of Artificial Sequence: Synthetic peptide
PGA

SEQ ID NO: 5097 - protein, 3 aa, Artificial Sequence
  Description of Artificial Sequence: Synthetic peptide
  MOD_RES (2)..(2): Any amino acid
DXD

SEQ ID NO: 5098 - protein, 3 aa, Artificial Sequence
  Description of Artificial Sequence: Synthetic peptide
  MOD_RES (2)..(2): Any amino acid
AXP

SEQ ID NO: 5099 - protein, 3 aa, Artificial Sequence
  Description of Artificial Sequence: Synthetic peptide
  MOD_RES (2)..(2): Any amino acid
NXL

SEQ ID NO: 5100 - protein, 3 aa, Artificial Sequence
  Description of Artificial Sequence: Synthetic peptide
  MOD_RES (2)..(2): Any amino acid
NXT

SEQ ID NO: 5101 - protein, 4 aa, Artificial Sequence
  Description of Artificial Sequence: Synthetic peptide
  MOD_RES (2)..(3): Any amino acid
RXXE

SEQ ID NO: 5102 - protein, 3 aa, Artificial Sequence
  Description of Artificial Sequence: Synthetic peptide
PLP

SEQ ID NO: 5103 - protein, 5 aa, Artificial Sequence
  Description of Artificial Sequence: Synthetic peptide
  MOD_RES (3)..(4): Any amino acid
EAXXR

SEQ ID NO: 5104 - protein, 6 aa, Artificial Sequence
  Description of Artificial Sequence: Synthetic peptide
  MOD_RES (2)..(5): Any amino acid
KXXXXE

SEQ ID NO: 5105 - protein, 4 aa, Artificial Sequence
  Description of Artificial Sequence: Synthetic peptide
  MOD_RES (2)..(3): Any amino acid
SXXN

SEQ ID NO: 5106 - protein, 4 aa, Artificial Sequence
  Description of Artificial Sequence: Synthetic peptide
  MOD_RES (2)..(3): Any amino acid
NXXA

SEQ ID NO: 5107 - protein, 3 aa, Artificial Sequence
  Description of Artificial Sequence: Synthetic peptide
  MOD_RES (2)..(2): Any amino acid
RXL

SEQ ID NO: 5108 - protein, 3 aa, Artificial Sequence
  Description of Artificial Sequence: Synthetic peptide
  MOD_RES (2)..(2): Any amino acid
NXG

SEQ ID NO: 5109 - protein, 3 aa, Artificial Sequence
  Description of Artificial Sequence: Synthetic peptide
  MOD_RES (2)..(2): Any amino acid
DXA

SEQ ID NO: 5110 - protein, 2 aa, Artificial Sequence
  Description of Artificial Sequence: Synthetic peptide
GF

SEQ ID NO: 5111 - protein, 5 aa, Artificial Sequence
  Description of Artificial Sequence: Synthetic peptide
  MOD_RES (2)..(4): Any amino acid
LXXXL

SEQ ID NO: 5112 - protein, 5 aa, Artificial Sequence
  Description of Artificial Sequence: Synthetic peptide
  MOD_RES (2)..(4): Any amino acid
EXXXQ

SEQ ID NO: 5113 - protein, 2 aa, Artificial Sequence
  Description of Artificial Sequence: Synthetic peptide
FG

SEQ ID NO: 5114 - protein, 3 aa, Artificial Sequence
  Description of Artificial Sequence: Synthetic peptide
  MOD_RES (2)..(2): Any amino acid
TXA

SEQ ID NO: 5115 - protein, 4 aa, Artificial Sequence
  Description of Artificial Sequence: Synthetic peptide
  MOD_RES (2)..(3): Any amino acid
SXXP

SEQ ID NO: 5116 - protein, 3 aa, Artificial Sequence
  Description of Artificial Sequence: Synthetic peptide
  MOD_RES (2)..(2): Any amino acid
YXE

SEQ ID NO: 5117 - protein, 3 aa, Artificial Sequence
  Description of Artificial Sequence: Synthetic peptide
  MOD_RES (2)..(2): Any amino acid
DXT

SEQ ID NO: 5118 - protein, 3 aa, Artificial Sequence
  Description of Artificial Sequence: Synthetic peptide
  MOD_RES (2)..(2): Any amino acid
SXG

SEQ ID NO: 5119 - protein, 3 aa, Artificial Sequence
  Description of Artificial Sequence: Synthetic peptide
  MOD_RES (2)..(2): Any amino acid
TXL

SEQ ID NO: 5120 - protein, 4 aa, Artificial Sequence
  Description of Artificial Sequence: Synthetic peptide
  MOD_RES (2)..(3): Any amino acid
TXXR

SEQ ID NO: 5121 - protein, 5 aa, Artificial Sequence
  Description of Artificial Sequence: Synthetic peptide
  MOD_RES (2)..(4): Any amino acid
VXXXK

SEQ ID NO: 5122 - protein, 5 aa, Artificial Sequence
  Description of Artificial Sequence: Synthetic peptide
  MOD_RES (2)..(4): Any amino acid
SXXXL

SEQ ID NO: 5123 - protein, 3 aa, Artificial Sequence
  Description of Artificial Sequence: Synthetic peptide
  MOD_RES (2)..(2): Any amino acid
YXY

SEQ ID NO: 5124 - protein, 5 aa, Artificial Sequence
  Description of Artificial Sequence: Synthetic peptide
  MOD_RES (2)..(4): Any amino acid
YXXXA

SEQ ID NO: 5125 - protein, 4 aa, Artificial Sequence
  Description of Artificial Sequence: Synthetic peptide
  MOD_RES (2)..(3): Any amino acid
QXXL

SEQ ID NO: 5126 - protein, 6 aa, Artificial Sequence
  Description of Artificial Sequence: Synthetic peptide
  MOD_RES (2)..(5): Any amino acid
SXXXXE

SEQ ID NO: 5127 - protein, 3 aa, Artificial Sequence
  Description of Artificial Sequence: Synthetic peptide
  MOD_RES (2)..(2): Any amino acid
HXD

SEQ ID NO: 5128 - protein, 4 aa, Artificial Sequence
  Description of Artificial Sequence: Synthetic peptide
  MOD_RES (2)..(3): Any amino acid
RXXN

SEQ ID NO: 5129 - protein, 5 aa, Artificial Sequence
  Description of Artificial Sequence: Synthetic peptide
  MOD_RES (2)..(4): Any amino acid
NXXXK

SEQ ID NO: 5130 - protein, 5 aa, Artificial Sequence
  Description of Artificial Sequence: Synthetic peptide
  MOD_RES (2)..(4): Any amino acid
AXXXG

SEQ ID NO: 5131 - protein, 4 aa, Artificial Sequence
  Description of Artificial Sequence: Synthetic peptide
  MOD_RES (2)..(3): Any amino acid
DXXI

SEQ ID NO: 5132 - protein, 3 aa, Artificial Sequence
  Description of Artificial Sequence: Synthetic peptide
  MOD_RES (2)..(2): Any amino acid
NXD

SEQ ID NO: 5133 - protein, 3 aa, Artificial Sequence
  Description of Artificial Sequence: Synthetic peptide
  MOD_RES (2)..(2): Any amino acid
SXD

SEQ ID NO: 5134 - protein, 4 aa, Artificial Sequence
  Description of Artificial Sequence: Synthetic peptide
  MOD_RES (2)..(3): Any amino acid
SXXS

SEQ ID NO: 5135 - protein, 5 aa, Artificial Sequence
  Description of Artificial Sequence: Synthetic peptide
  MOD_RES (2)..(4): Any amino acid
DXXXR

SEQ ID NO: 5136 - protein, 4 aa, Artificial Sequence
  Description of Artificial Sequence: Synthetic peptide
  MOD_RES (2)..(3): Any amino acid
QXXF

SEQ ID NO: 5137 - protein, 5 aa, Artificial Sequence
  Description of Artificial Sequence: Synthetic peptide
  MOD_RES (2)..(4): Any amino acid
DXXXL

SEQ ID NO: 5138 - protein, 4 aa, Artificial Sequence
  Description of Artificial Sequence: Synthetic peptide
  MOD_RES (2)..(3): Any amino acid
FXXR

SEQ ID NO: 5139 - protein, 4 aa, Artificial Sequence
  Description of Artificial Sequence: Synthetic peptide
  MOD_RES (2)..(3): Any amino acid
RXXA

SEQ ID NO: 5140 - protein, 5 aa, Artificial Sequence
  Description of Artificial Sequence: Synthetic peptide
  MOD_RES (2)..(4): Any amino acid
RXXXK

SEQ ID NO: 5141 - protein, 4 aa, Artificial Sequence
  Description of Artificial Sequence: Synthetic peptide
  MOD_RES (2)..(3): Any amino acid
HXXD

SEQ ID NO: 5142 - protein, 5 aa, Artificial Sequence
  Description of Artificial Sequence: Synthetic peptide
  MOD_RES (2)..(4): Any amino acid
EXXXP

SEQ ID NO: 5143 - protein, 5 aa, Artificial Sequence
  Description of Artificial Sequence: Synthetic peptide
  MOD_RES (2)..(4): Any amino acid
KXXXE

SEQ ID NO: 5144 - protein, 4 aa, Artificial Sequence
  Description of Artificial Sequence: Synthetic peptide
  MOD_RES (2)..(3): Any amino acid
TXXN

SEQ ID NO: 5145 - protein, 3 aa, Artificial Sequence
  Description of Artificial Sequence: Synthetic peptide
  MOD_RES (2)..(2): Any amino acid
QXG

SEQ ID NO: 5146 - protein, 3 aa, Artificial Sequence
  Description of Artificial Sequence: Synthetic peptide
  MOD_RES (2)..(2): Any amino acid
TXD

SEQ ID NO: 5147 - protein, 4 aa, Artificial Sequence
  Description of Artificial Sequence: Synthetic peptide
  MOD_RES (2)..(3): Any amino acid
EXXG

SEQ ID NO: 5148 - protein, 5 aa, Artificial Sequence
  Description of Artificial Sequence: Synthetic peptide
  MOD_RES (2)..(4): Any amino acid
FXXXA

SEQ ID NO: 5149 - protein, 5 aa, Artificial Sequence
  Description of Artificial Sequence: Synthetic peptide
  MOD_RES (2)..(4): Any amino acid
LXXXF

SEQ ID NO: 5150 - protein, 3 aa, Artificial Sequence
  Description of Artificial Sequence: Synthetic peptide
  MOD_RES (2)..(2): Any amino acid
RXG

SEQ ID NO: 5151 - protein, 3 aa, Artificial Sequence
  Description of Artificial Sequence: Synthetic peptide
  MOD_RES (2)..(2): Any amino acid
DXL

SEQ ID NO: 5152 - protein, 4 aa, Artificial Sequence
  Description of Artificial Sequence: Synthetic peptide
  MOD_RES (3)..(3): Any amino acid
PGXP

SEQ ID NO: 5153 - protein, 3 aa, Artificial Sequence
  Description of Artificial Sequence: Synthetic peptide
  MOD_RES (2)..(2): Any amino acid
DXG

SEQ ID NO: 5154 - protein, 3 aa, Artificial Sequence
  Description of Artificial Sequence: Synthetic peptide
  MOD_RES (2)..(2): Any amino acid
DXG

SEQ ID NO: 5155 - protein, 4 aa, Artificial Sequence
  Description of Artificial Sequence: Synthetic peptide
  MOD_RES (2)..(3): Any amino acid
RXXN

SEQ ID NO: 5156 - protein, 4 aa, Artificial Sequence
  Description of Artificial Sequence: Synthetic peptide
  MOD_RES (2)..(3): Any amino acid
AXXQ

SEQ ID NO: 5157 - protein, 4 aa, Artificial Sequence
  Description of Artificial Sequence: Synthetic peptide
  MOD_RES (2)..(3): Any amino acid
EXXN

SEQ ID NO: 5158 - protein, 3 aa, Artificial Sequence
  Description of Artificial Sequence: Synthetic peptide
  MOD_RES (2)..(2): Any amino acid
DXV

SEQ ID NO: 5159 - protein, 5 aa, Artificial Sequence
  Description of Artificial Sequence: Synthetic peptide
  MOD_RES (2)..(4): Any amino acid
TXXXG

SEQ ID NO: 5160 - protein, 3 aa, Artificial Sequence
  Description of Artificial Sequence: Synthetic peptide
  MOD_RES (2)..(2): Any amino acid
AXV

SEQ ID NO: 5161 - protein, 5 aa, Artificial Sequence
  Description of Artificial Sequence: Synthetic peptide
  MOD_RES (2)..(3): Any amino acid
EXXKR

SEQ ID NO: 5162 - protein, 3 aa, Artificial Sequence
  Description of Artificial Sequence: Synthetic peptide
  MOD_RES (2)..(2): Any amino acid
SXL

SEQ ID NO: 5163 - protein, 3 aa, Artificial Sequence
  Description of Artificial Sequence: Synthetic peptide
  MOD_RES (2)..(2): Any amino acid
DXP

SEQ ID NO: 5164 - protein, 3 aa, Artificial Sequence
  Description of Artificial Sequence: Synthetic peptide
  MOD_RES (2)..(2): Any amino acid
AXG

SEQ ID NO: 5165 - protein, 4 aa, Artificial Sequence
  Description of Artificial Sequence: Synthetic peptide
  MOD_RES (2)..(3): Any amino acid
QXXA

SEQ ID NO: 5166 - protein, 5 aa, Artificial Sequence
  Description of Artificial Sequence: Synthetic peptide
  MOD_RES (2)..(4): Any amino acid
PXXXL

SEQ ID NO: 5167 - protein, 3 aa, Artificial Sequence
  Description of Artificial Sequence: Synthetic peptide
GAD

SEQ ID NO: 5168 - protein, 3 aa, Artificial Sequence
  Description of Artificial Sequence: Synthetic peptide
  MOD_RES (2)..(2): Any amino acid
RXT

SEQ ID NO: 5169 - protein, 3 aa, Artificial Sequence
  Description of Artificial Sequence: Synthetic peptide
  MOD_RES (2)..(2): Any amino acid
IXQ

SEQ ID NO: 5170 - protein, 5 aa, Artificial Sequence
  Description of Artificial Sequence: Synthetic peptide
  MOD_RES (2)..(4): Any amino acid
PXXXK

SEQ ID NO: 5171 - protein, 3 aa, Artificial Sequence
  Description of Artificial Sequence: Synthetic peptide
DGR

SEQ ID NO: 5172 - protein, 2 aa, Artificial Sequence
  Description of Artificial Sequence: Synthetic peptide
YH

SEQ ID NO: 5173 - protein, 4 aa, Artificial Sequence
  Description of Artificial Sequence: Synthetic peptide
  MOD_RES (2)..(3): Any amino acid
PXXL

SEQ ID NO: 5174 - protein, 4 aa, Artificial Sequence
  Description of Artificial Sequence: Synthetic peptide
  MOD_RES (2)..(3): Any amino acid
RXXG

SEQ ID NO: 5175 - protein, 3 aa, Artificial Sequence
  Description of Artificial Sequence: Synthetic peptide
  MOD_RES (2)..(2): Any amino acid
EXY

SEQ ID NO: 5176 - protein, 4 aa, Artificial Sequence
  Description of Artificial Sequence: Synthetic peptide
  MOD_RES (2)..(3): Any amino acid
DXXQ

SEQ ID NO: 5177 - protein, 4 aa, Artificial Sequence
  Description of Artificial Sequence: Synthetic peptide
  MOD_RES (2)..(3): Any amino acid
LXXE

SEQ ID NO: 5178 - protein, 4 aa, Artificial Sequence
  Description of Artificial Sequence: Synthetic peptide
  MOD_RES (2)..(3): Any amino acid
EXXG

SEQ ID NO: 5179 - protein, 5 aa, Artificial Sequence
  Description of Artificial Sequence: Synthetic peptide
  MOD_RES (2)..(4): Any amino acid
EXXXE

SEQ ID NO: 5180 - protein, 3 aa, Artificial Sequence
  Description of Artificial Sequence: Synthetic peptide
  MOD_RES (2)..(2): Any amino acid
VXP

SEQ ID NO: 5181 - protein, 2 aa, Artificial Sequence
  Description of Artificial Sequence: Synthetic peptide
AS

SEQ ID NO: 5182 - protein, 4 aa, Artificial Sequence
  Description of Artificial Sequence: Synthetic peptide
  MOD_RES (2)..(3): Any amino acid
TXXD

SEQ ID NO: 5183 - protein, 3 aa, Artificial Sequence
  Description of Artificial Sequence: Synthetic peptide
  MOD_RES (2)..(2): Any amino acid
KXG

SEQ ID NO: 5184 - protein, 3 aa, Artificial Sequence
  Description of Artificial Sequence: Synthetic peptide
  MOD_RES (2)..(2): Any amino acid
TXK

SEQ ID NO: 5185 - protein, 3 aa, Artificial Sequence
  Description of Artificial Sequence: Synthetic peptide
  MOD_RES (2)..(2): Any amino acid
YXR

SEQ ID NO: 5186 - protein, 5 aa, Artificial Sequence
  Description of Artificial Sequence: Synthetic peptide
  MOD_RES (2)..(4): Any amino acid
EXXXK

SEQ ID NO: 5187 - protein, 5 aa, Artificial Sequence
  Description of Artificial Sequence: Synthetic peptide
  MOD_RES (2)..(4): Any amino acid
LXXXI

SEQ ID NO: 5188 - protein, 3 aa, Artificial Sequence
  Description of Artificial Sequence: Synthetic peptide
  MOD_RES (2)..(2): Any amino acid
CXA

SEQ ID NO: 5189 - protein, 4 aa, Artificial Sequence
  Description of Artificial Sequence: Synthetic peptide
  MOD_RES (2)..(3): Any amino acid
QXXV

SEQ ID NO: 5190 - protein, 4 aa, Artificial Sequence
  Description of Artificial Sequence: Synthetic peptide
  MOD_RES (2)..(3): Any amino acid
NXXK

SEQ ID NO: 5191 - protein, 4 aa, Artificial Sequence
  Description of Artificial Sequence: Synthetic peptide
  MOD_RES (2)..(3): Any amino acid
EXXL

SEQ ID NO: 5192 - protein, 3 aa, Artificial Sequence
  Description of Artificial Sequence: Synthetic peptide
PGT

SEQ ID NO: 5193 - protein, 5 aa, Artificial Sequence
  Description of Artificial Sequence: Synthetic peptide
  MOD_RES (2)..(4): Any amino acid
SXXXK

SEQ ID NO: 5194 - protein, 4 aa, Artificial Sequence
  Description of Artificial Sequence: Synthetic peptide
  MOD_RES (2)..(3): Any amino acid
QXXS

SEQ ID NO: 5195 - protein, 3 aa, Artificial Sequence
  Description of Artificial Sequence: Synthetic peptide
  MOD_RES (2)..(2): Any amino acid
RXG

SEQ ID NO: 5196 - protein, 2 aa, Artificial Sequence
  Description of Artificial Sequence: Synthetic peptide
KH

SEQ ID NO: 5197 - protein, 3 aa, Artificial Sequence
  Description of Artificial Sequence: Synthetic peptide
  MOD_RES (2)..(2): Any amino acid
DXQ

SEQ ID NO: 5198 - protein, 4 aa, Artificial Sequence
  Description of Artificial Sequence: Synthetic peptide
  MOD_RES (2)..(3): Any amino acid
EXXN

SEQ ID NO: 5199 - protein, 2 aa, Artificial Sequence
  Description of Artificial Sequence: Synthetic peptide
GP

SEQ ID NO: 5200 - protein, 3 aa, Artificial Sequence
  Description of Artificial Sequence: Synthetic peptide
  MOD_RES (2)..(2): Any amino acid
EXH

SEQ ID NO: 5201 - protein, 3 aa, Artificial Sequence
  Description of Artificial Sequence: Synthetic peptide
  MOD_RES (2)..(2): Any amino acid
IXY

SEQ ID NO: 5202 - protein, 2 aa, Artificial Sequence
  Description of Artificial Sequence: Synthetic peptide
TS

SEQ ID NO: 5203 - protein, 2 aa, Artificial Sequence
  Description of Artificial Sequence: Synthetic peptide
AA

SEQ ID NO: 5204 - protein, 5 aa, Artificial Sequence
  Description of Artificial Sequence: Synthetic peptide
  MOD_RES (2)..(4): Any amino acid
HXXXA

SEQ ID NO: 5205 - protein, 3 aa, Artificial Sequence
  Description of Artificial Sequence: Synthetic peptide
  MOD_RES (2)..(2): Any amino acid
RXS

SEQ ID NO: 5206 - protein, 3 aa, Artificial Sequence
  Description of Artificial Sequence: Synthetic peptide
  MOD_RES (2)..(2): Any amino acid
AXP

SEQ ID NO: 5207 - protein, 4 aa, Artificial Sequence
  Description of Artificial Sequence: Synthetic peptide
  MOD_RES (2)..(3): Any amino acid
AXXP

SEQ ID NO: 5208 - protein, 4 aa, Artificial Sequence
  Description of Artificial Sequence: Synthetic peptide
  MOD_RES (2)..(3): Any amino acid
AXXG

SEQ ID NO: 5209 - protein, 5 aa, Artificial Sequence
  Description of Artificial Sequence: Synthetic peptide
  MOD_RES (2)..(4): Any amino acid
VXXXS

SEQ ID NO: 5210 - protein, 3 aa, Artificial Sequence
  Description of Artificial Sequence: Synthetic peptide
  MOD_RES (2)..(2): Any amino acid
GXF

SEQ ID NO: 5211 - protein, 3 aa, Artificial Sequence
  Description of Artificial Sequence: Synthetic peptide
  MOD_RES (2)..(2): Any amino acid
AXN

SEQ ID NO: 5212 - protein, 4 aa, Artificial Sequence
  Description of Artificial Sequence: Synthetic peptide
  MOD_RES (2)..(3): Any amino acid
QXXK

SEQ ID NO: 5213 - protein, 3 aa, Artificial Sequence
  Description of Artificial Sequence: Synthetic peptide
  MOD_RES (2)..(2): Any amino acid
SXY

SEQ ID NO: 5214 - protein, 4 aa, Artificial Sequence
  Description of Artificial Sequence: Synthetic peptide
  MOD_RES (2)..(2): Any amino acid
DXDG

SEQ ID NO: 5215 - protein, 5 aa, Artificial Sequence
  Description of Artificial Sequence: Synthetic peptide
  MOD_RES (2)..(4): Any amino acid
AXXXE

SEQ ID NO: 5216 - protein, 5 aa, Artificial Sequence
  Description of Artificial Sequence: Synthetic peptide
  MOD_RES (2)..(4): Any amino acid
KXXXL

SEQ ID NO: 5217 - protein, 3 aa, Artificial Sequence
  Description of Artificial Sequence: Synthetic peptide
  MOD_RES (2)..(2): Any amino acid
TXH

SEQ ID NO: 5218 - protein, 4 aa, Artificial Sequence
  Description of Artificial Sequence: Synthetic peptide
  MOD_RES (2)..(3): Any amino acid
YXXT

SEQ ID NO: 5219 - protein, 2 aa, Artificial Sequence
  Description of Artificial Sequence: Synthetic peptide
SA

SEQ ID NO: 5220 - protein, 4 aa, Artificial Sequence
  Description of Artificial Sequence: Synthetic peptide
  MOD_RES (2)..(3): Any amino acid
DXXN

SEQ ID NO: 5221 - protein, 3 aa, Artificial Sequence
  Description of Artificial Sequence: Synthetic peptide
  MOD_RES (2)..(2): Any amino acid
RXG

SEQ ID NO: 5222 - protein, 4 aa, Artificial Sequence
  Description of Artificial Sequence: Synthetic peptide
  MOD_RES (2)..(3): Any amino acid
EXXL

SEQ ID NO: 5223 - protein, 3 aa, Artificial Sequence
  Description of Artificial Sequence: Synthetic peptide
  MOD_RES (2)..(2): Any amino acid
DXT

SEQ ID NO: 5224 - protein, 3 aa, Artificial Sequence
  Description of Artificial Sequence: Synthetic peptide
GVP

SEQ ID NO: 5225 - protein, 4 aa, Artificial Sequence
  Description of Artificial Sequence: Synthetic peptide
  MOD_RES (2)..(3): Any amino acid
NXXE

SEQ ID NO: 5226 - protein, 4 aa, Artificial Sequence
  Description of Artificial Sequence: Synthetic peptide
  MOD_RES (2)..(3): Any amino acid
QXXP

SEQ ID NO: 5227 - protein, 6 aa, Artificial Sequence
  Description of Artificial Sequence: Synthetic 6xHis tag
HHHHHH

SEQ ID NO: 5228 - protein, 8 aa, Artificial Sequence
  Description of Artificial Sequence: Synthetic peptide
LEHHHHHH

SEQ ID NO: 5229 - protein, 10 aa, Artificial Sequence
  Description of Artificial Sequence: Synthetic peptide
MGHHHHHHSH

SEQ ID NO: 5230 - protein, 8 aa, Artificial Sequence
  Description of Artificial Sequence: Synthetic peptide
LEHHHHHH

SEQ ID NO: 5231 - protein, 8 aa, Artificial Sequence
  Description of Artificial Sequence: Synthetic peptide
LEHHHHHH

What is claimed is:

1. A method for increasing the number of high-quality crystal-packing motifs in a target protein to improve its crystallization properties, comprising:
   a. providing a sub-epitope library containing local crystal-packing motifs in the PDB that span at most two-successive regular secondary structural elements and flanking loops, wherein each sub-epitope is ranked by p-value according to its overrepresentation in crystal-packing interfaces formed by crystal structures in the PDB that do not have excessively close inter-protein contacts;
   b. identifying one or more specific candidate sites in the sequence of the target protein for introduction of each sub-epitope in the library by:
      i. using a computer program to search a protein sequence database for proteins homologous to the target protein;
      ii. using a computer program to perform a multiple sequence alignment of the target sequence with the homologous proteins identified by the search program;
      iii. using a computer program to predict the secondary structure of the target protein based on its sequence; and
      iv. specifying exact sites in the target protein for introduction of a sub-epitope from the library based on the occurrence of residues similar to those in the sub-epitope at aligned positions in one of the homologous protein sequences and on conservation of the secondary structure of the sub-epitope in the target protein; and
   c. prioritizing sub-epitopes for introduction via mutagenesis at the specific sites identified for that sub-epitope in the target protein based on the overrepresentation p-value of the sub-epitope in crystal-packing interfaces; and
   d. further prioritizing sub-epitopes for introduction via mutagenesis at the specific sites identified for that sub-epitope in the target protein based on whether the number of sub-epitopes of equal or better overrepresentation p-value is increased by the required mutations in the target sequence; and
   e. obtaining a mutant protein sequence of the target protein based on the sub-epitope prioritization steps and wherein the mutant protein sequence is expressed in an expression system.

2. The method of claim 1 in which the sub-epitope library comprises the sequences in tables 1-38.

3. The method of claim 1, in which the candidate sub-epitopes for substitution at the candidate sites is selected from tables 8 or 12.

4. A method for increasing the number of high-quality crystal-packing motifs in a target protein to improve its crystallization properties comprising:
   a. providing a sub-epitope library containing local crystal-packing motifs in the PDB that span at most two-successive regular secondary structural elements and flanking loops, wherein each sub-epitope is ranked by p-value according to its overrepresentation in crystal-packing interfaces formed by crystal structures in the PDB that do not have excessively close inter-protein contacts;
   b. identifying one or more specific candidate sites in the sequence of the target protein for introduction of each sub-epitope in the library by:
      i. using a computer program to search a protein sequence database for proteins homologous to the target protein;
      ii. using a computer program to perform a multiple sequence alignment of the target sequence with the homologous proteins identified by the search program;
      iii. using a computer program to predict the secondary structure of the target protein based on its sequence; and
      iv. specifying exact sites in the target protein for introduction of a sub-epitope from the library based on the occurrence of residues similar to those in the sub-epitope at aligned positions in one of the homologous protein sequences and on conservation of the secondary structure of the sub-epitope in the target protein; and
   c. prioritizing sub-epitopes for introduction via mutagenesis at the specific sites identified for that sub-epitope in the target protein based on the overrepresentation p-value of the sub-epitope in crystal-packing interfaces; and
   d. further prioritizing sub-epitopes for introduction via mutagenesis at the specific sites identified for that sub-epitope in the target protein based on whether the number of sub-epitopes of equal or better overrepresentation p-value is increased by the required mutations in the target sequence; and
   e. obtaining a mutant protein sequence of the target protein based on the sub-epitope prioritization steps and wherein the mutant protein sequence is expressed in an expression system, and the expressed protein is crystallized and its structure is determined with high-resolution X-ray crystallography.

5. A method for increasing the number of high-quality crystal-packing motifs in a target protein to improve its crystallization properties, comprising
   a. providing a sub-epitope library containing local crystal-packing motifs in the PDB that span at most two-successive regular secondary structural elements and flanking loops, wherein each sub-epitope is ranked by p-value according to its overrepresentation in crystal-packing interfaces formed by crystal structures in the PDB that do not have excessively close inter-protein contacts;

b. identifying one or more specific candidate sites in the sequence of the target protein for introduction of each sub-epitope in the library by:
  i. using a computer program to search a protein sequence database for proteins homologous to the target protein;
  ii. using a computer program to perform a multiple sequence alignment of the target sequence with the homologous proteins identified by the search program;
  iii. using a computer program to predict the secondary structure of the target protein based on its sequence; and
  iv. specifying exact sites in the target protein for introduction of a sub-epitope from the library based on the occurrence of residues similar to those in the sub-epitope at aligned positions in one of the homologous protein sequences and on conservation of the secondary structure of the sub-epitope in the target protein; and c. prioritizing sub-epitopes for introduction via mutagenesis at the specific sites identified for that sub-epitope in the target protein based on the overrepresentation p-value of the sub-epitope in crystal-packing interfaces; and d. further prioritizing sub-epitopes for introduction via mutagenesis at the specific sites identified for that sub-epitope in the target protein based on whether the number of sub-epitopes of equal or better overrepresentation p-value is increased by the required mutations in the target sequence; and e. obtaining a mutant protein sequence of the target protein based on the sub-epitope prioritization steps and wherein the mutant protein sequence is expressed in an expression system to provide a mutant protein with the mutant protein sequence and is crystallized and its structure is determined with high-resolution X-ray crystallography.

6. The method of claim 5, in which the sub-epitope library comprises the sequences in tables 1-38.

7. The method of claim 5, in which the candidate sub-epitopes for substitution at the candidate sites is selected from tables 8 or 12.

* * * * *